US012435149B2

(12) United States Patent
Bates et al.

(10) Patent No.: US 12,435,149 B2
(45) Date of Patent: Oct. 7, 2025

(54) METHOD OF TREATING OR AMELIORATING METABOLIC DISORDERS USING BINDING PROTEINS FOR GASTRIC INHIBITORY PEPTIDE RECEPTOR (GIPR) IN COMBINATION WITH GLP-1 AGONISTS

(71) Applicant: AMGEN INC., Thousand Oaks, CA (US)

(72) Inventors: Darren L Bates, Oak Park, CA (US); Donghui Shi, Thousand Oaks, CA (US); David J. Lloyd, Thousand Oaks, CA (US); Pavel Bondarenko, Thousand Oaks, CA (US); Mark L Michaels, Encino, CA (US); Todd Hager, Agoura Hills, CA (US); Xiaoshan Min, Burlingame, CA (US); Aiko Umeda, Woodland Hills, CA (US); Irwin Chen, Los Angeles, CA (US); Zhulun Wang, Palo Alto, CA (US)

(73) Assignee: AMGEN INC., Thousand Oaks, CA (US)

( * ) Notice: Subject to any disclaimer, the term of this patent is extended or adjusted under 35 U.S.C. 154(b) by 0 days.

(21) Appl. No.: 16/623,750

(22) PCT Filed: Jun. 20, 2018

(86) PCT No.: PCT/US2018/038638

§ 371 (c)(1),
(2) Date: Dec. 17, 2019

(87) PCT Pub. No.: WO2018/237097

PCT Pub. Date: Dec. 27, 2018

(65) Prior Publication Data

US 2021/0087286 A1 Mar. 25, 2021

Related U.S. Application Data

(60) Provisional application No. 62/522,559, filed on Jun. 20, 2017.

(51) Int. Cl.
*C07K 16/28* (2006.01)
*A61K 9/00* (2006.01)
*A61K 38/26* (2006.01)

(52) U.S. Cl.
CPC .......... *C07K 16/2869* (2013.01); *A61K 38/26* (2013.01); *A61K 9/0019* (2013.01); *C07K 2317/21* (2013.01); *C07K 2317/54* (2013.01); *C07K 2317/55* (2013.01)

(58) Field of Classification Search
CPC ............ C07K 16/2869; C07K 2317/21; C07K 2317/54; C07K 2317/55; C07K 2317/75; C07K 2317/92; C07K 2317/94; A61K 38/26; A61K 9/0019
See application file for complete search history.

(56) References Cited

U.S. PATENT DOCUMENTS

| | | | |
|---|---|---|---|
| 3,773,919 | A | 11/1973 | Boswell et al. |
| 4,399,216 | A | 8/1983 | Axel et al. |
| 4,619,794 | A | 10/1986 | Hauser |
| 4,740,461 | A | 4/1988 | Kaufman |
| 4,816,567 | A | 3/1989 | Cabilly et al. |
| 4,912,040 | A | 3/1990 | Kaufman et al. |
| 4,946,778 | A | 8/1990 | Ladner et al. |
| 4,959,455 | A | 9/1990 | Clark et al. |
| 4,965,195 | A | 10/1990 | Namen et al. |
| 4,968,607 | A | 11/1990 | Dower et al. |
| 5,011,912 | A | 4/1991 | Hopp et al. |
| 5,260,203 | A | 11/1993 | Ladner et al. |
| 5,292,658 | A | 3/1994 | Cormier et al. |
| 5,418,155 | A | 5/1995 | Cormier et al. |
| 5,470,582 | A | 11/1995 | Supersaxo et al. |
| 5,530,101 | A | 6/1996 | Queen et al. |
| 5,545,618 | A | 8/1996 | Buckley et al. |
| 5,545,806 | A | 8/1996 | Lonberg et al. |
| 5,545,807 | A | 8/1996 | Surami et al. |
| 5,569,825 | A | 10/1996 | Lonberg et al. |
| 5,585,089 | A | 12/1996 | Queen et al. |

(Continued)

FOREIGN PATENT DOCUMENTS

| | | |
|---|---|---|
| AU | 31399/84 A | 1/1984 |
| CL | 2018001695 A1 | 11/2018 |

(Continued)

OTHER PUBLICATIONS

Ravn et al. "Structural and Pharmacological Characterization of Novel Potent and Selective Monoclonal Antibody Antagonists of Glucose-dependent Insulinotropic Polypeptide Receptor". 2013. The Journal of Biological Chemistry, vol. 288, No. 27, pp. 19760-19772. (Year: 2013).*

(Continued)

*Primary Examiner* — Scarlett Y Goon
*Assistant Examiner* — Audrey L Buttice
(74) *Attorney, Agent, or Firm* — Jonathan M. Dermott

(57) ABSTRACT

Methods of treating metabolic diseases and disorders using an antigen binding protein specific for the GIPR polypeptide are provided. In various embodiments the metabolic disease or disorder is type 2 diabetes, obesity, dyslipidemia, elevated glucose levels, elevated insulin levels and diabetic nephropathy. In certain embodiments the antigen binding protein is administered in combination with a GLP-1 receptor agonist.

49 Claims, No Drawings

Specification includes a Sequence Listing.

(56) References Cited

U.S. PATENT DOCUMENTS

| | | | |
|---|---|---|---|
| 5,625,126 | A | 4/1997 | Lonberg et al. |
| 5,633,425 | A | 5/1997 | Lonberg et al. |
| 5,661,016 | A | 8/1997 | Lonberg et al. |
| 5,683,888 | A | 11/1997 | Campbell |
| 5,693,761 | A | 12/1997 | Queen et al. |
| 5,693,762 | A | 12/1997 | Queen et al. |
| 5,741,668 | A | 4/1998 | Ward et al. |
| 5,770,429 | A | 6/1998 | Lonberg et al. |
| 5,777,079 | A | 7/1998 | Tsien et al. |
| 5,789,650 | A | 8/1998 | Lonberg et al. |
| 5,804,387 | A | 9/1998 | Cormack et al. |
| 5,814,318 | A | 9/1998 | Lonberg et al. |
| 5,874,299 | A | 2/1999 | Lonberg et al. |
| 5,874,304 | A | 2/1999 | Zolotukhin et al. |
| 5,876,995 | A | 3/1999 | Bryan |
| 5,877,397 | A | 3/1999 | Lonberg et al. |
| 5,925,558 | A | 7/1999 | Tsien et al. |
| 6,114,598 | A | 9/2000 | Kucherlapati et al. |
| 6,162,963 | A | 12/2000 | Kucherlapati et al. |
| 6,180,370 | B1 | 1/2001 | Queen et al. |
| 6,255,458 | B1 | 7/2001 | Lonberg et al. |
| 6,270,964 | B1 | 8/2001 | Michnick et al. |
| 6,300,129 | B1 | 10/2001 | Lonberg et al. |
| 6,506,724 | B1 | 1/2003 | Hiles et al. |
| 6,565,841 | B1 | 5/2003 | Niven et al. |
| 6,673,986 | B1 | 1/2004 | Kucherlapati et al. |
| 6,703,359 | B1 | 3/2004 | Young et al. |
| 6,713,610 | B1 | 3/2004 | Kucherlapati et al. |
| 6,753,165 | B1 | 6/2004 | Cox et al. |
| 6,833,268 | B1 | 12/2004 | Green et al. |
| 6,858,576 | B1 | 2/2005 | Young et al. |
| 6,872,700 | B1 | 3/2005 | Young et al. |
| 6,902,744 | B1 | 6/2005 | Emmot |
| 6,956,026 | B2 | 10/2005 | Beeley et al. |
| 7,045,337 | B2 | 5/2006 | Schultz et al. |
| 7,049,426 | B2 | 5/2006 | Green et al. |
| 7,064,244 | B2 | 6/2006 | Jakobovits et al. |
| 7,081,473 | B2 | 7/2006 | Tsubamoto et al. |
| 7,091,183 | B1 | 8/2006 | Wolfe et al. |
| 7,157,555 | B1 | 1/2007 | Beeley et al. |
| 7,220,721 | B1 | 5/2007 | Beeley et al. |
| 7,223,725 | B1 | 5/2007 | Beeley et al. |
| 7,368,427 | B1 | 5/2008 | Dong et al. |
| 7,456,254 | B2 | 11/2008 | Wright et al. |
| 7,521,423 | B2 | 4/2009 | Young et al. |
| 7,572,451 | B2 | 8/2009 | Bachmann et al. |
| 7,666,838 | B2 | 2/2010 | O'Harte et al. |
| 7,875,587 | B2 | 1/2011 | Gault et al. |
| 7,959,924 | B2 | 6/2011 | Bachmann et al. |
| 8,263,545 | B2 | 9/2012 | Levy et al. |
| 8,999,940 | B2 | 4/2015 | Dong |
| 10,294,303 | B2 * | 5/2019 | Yie ........................... A61P 3/10 |
| 10,905,772 | B2 | 2/2021 | Cheng et al. |
| 11,046,774 | B2 | 6/2021 | Yie et al. |
| 2003/0036504 | A1 | 2/2003 | Kolterman et al. |
| 2003/0157107 | A1 | 8/2003 | Miyawaki et al. |
| 2004/0029805 | A1 | 2/2004 | Wolfe et al. |
| 2004/0106547 | A1 | 6/2004 | Larsen et al. |
| 2005/0159379 | A1 | 7/2005 | McSwiggen et al. |
| 2006/0068910 | A1 | 3/2006 | Schmidt et al. |
| 2006/0094652 | A1 | 5/2006 | Levy et al. |
| 2006/0125763 | A1 | 6/2006 | Akai et al. |
| 2006/0275288 | A1 | 12/2006 | Grihalde et al. |
| 2008/0125371 | A1 | 5/2008 | Wolfe et al. |
| 2008/0182795 | A1 | 7/2008 | Wolfe et al. |
| 2008/0312098 | A1 | 12/2008 | Kozian et al. |
| 2008/0312157 | A1 | 12/2008 | Levy et al. |
| 2009/0036364 | A1 | 2/2009 | Levy et al. |
| 2009/0042922 | A1 | 2/2009 | Romo et al. |
| 2009/0074769 | A1 | 3/2009 | Glaesner et al. |
| 2009/0186817 | A1 | 7/2009 | Ghosh et al. |
| 2009/0209469 | A1 | 8/2009 | Kim et al. |
| 2010/0143392 | A1 | 6/2010 | Bachmann et al. |
| 2011/0136737 | A1 | 6/2011 | Levy et al. |
| 2012/0101037 | A1 | 4/2012 | Danho et al. |
| 2012/0157379 | A1 | 6/2012 | Hsu |
| 2012/0238493 | A1 | 9/2012 | DiMarchi et al. |
| 2012/0322725 | A1 | 12/2012 | DiMarchi et al. |
| 2013/0344524 | A1 | 12/2013 | Miyachi et al. |
| 2016/0194371 | A1 | 7/2016 | Boscheinen et al. |
| 2016/0297883 | A1 | 10/2016 | Gallo et al. |
| 2017/0114115 | A1 | 4/2017 | Alsina-Fernandez et al. |
| 2017/0275370 | A1 | 9/2017 | Yie et al. |
| 2018/0311372 | A1 | 11/2018 | Cheng et al. |
| 2019/0276546 | A1 | 9/2019 | Yie et al. |
| 2020/0384119 | A1 | 12/2020 | Walker et al. |
| 2021/0087286 | A1 | 3/2021 | Bates et al. |
| 2021/0154318 | A1 | 5/2021 | Cheng et al. |

FOREIGN PATENT DOCUMENTS

| | | | |
|---|---|---|---|
| CL | 2019/001963 | A1 | 4/2020 |
| CN | 101044162 | B | 10/2010 |
| CN | 109715662 | A | 5/2019 |
| EP | 0036676 | A1 | 9/1981 |
| EP | 0058481 | A1 | 8/1982 |
| EP | 0088046 | A2 | 9/1983 |
| EP | 0133988 | A2 | 3/1985 |
| EP | 0143949 | A1 | 6/1985 |
| EP | 0367566 | A1 | 5/1990 |
| EP | 0367566 | B1 | 5/1990 |
| EP | 0460846 | A1 | 12/1991 |
| EP | 0460846 | B1 | 12/1991 |
| EP | 0546073 | A1 | 9/1997 |
| EP | 0546073 | A4 | 9/1997 |
| EP | 0546073 | B1 | 9/1997 |
| EP | 1119625 | A1 | 8/2001 |
| EP | 1283058 | A1 | 2/2003 |
| JP | 2010-514835 | A | 5/2010 |
| JP | 2011/511753 | A | 4/2011 |
| KR | 2009-0096498 | A | 9/2009 |
| MX | 0395677 | | 9/2022 |
| PE | 0012080 | | 12/2016 |
| WO | 88/01649 | A1 | 3/1988 |
| WO | 90/04036 | A1 | 4/1990 |
| WO | 91/10741 | A1 | 7/1991 |
| WO | 92/03918 | A1 | 3/1992 |
| WO | 92/15673 | A1 | 9/1992 |
| WO | 92/22646 | A1 | 12/1992 |
| WO | 93/01227 | A1 | 1/1993 |
| WO | 93/15722 | A1 | 8/1993 |
| WO | 94/02602 | A1 | 2/1994 |
| WO | 94/20069 | A1 | 9/1994 |
| WO | 95/07463 | A1 | 3/1995 |
| WO | 96/33735 | A1 | 10/1996 |
| WO | 98/05351 | A1 | 2/1998 |
| WO | 98/14605 | A1 | 4/1998 |
| WO | 98/24464 | A1 | 6/1998 |
| WO | 98/24893 | A2 | 6/1998 |
| WO | 98/26277 | A2 | 6/1998 |
| WO | 99/07404 | A1 | 2/1999 |
| WO | 99/10494 | A2 | 3/1999 |
| WO | 99/25727 | A2 | 5/1999 |
| WO | 99/25728 | A1 | 5/1999 |
| WO | 99/40788 | A1 | 8/1999 |
| WO | 99/49019 | A2 | 9/1999 |
| WO | 00/20592 | A1 | 4/2000 |
| WO | 2000037098 | A1 | 6/2000 |
| WO | 00/41546 | A2 | 7/2000 |
| WO | 00/41548 | A2 | 7/2000 |
| WO | 00/73331 | A2 | 12/2000 |
| WO | 01/51078 | A1 | 7/2001 |
| WO | 01/055213 | A2 | 8/2001 |
| WO | 01/87341 | A1 | 11/2001 |
| WO | 2003/55914 | A2 | 7/2003 |
| WO | 03/072195 | A2 | 9/2003 |
| WO | 03/097031 | A1 | 11/2003 |
| WO | 03/099314 | A1 | 12/2003 |
| WO | 2004083211 | A1 | 9/2004 |
| WO | 2005000892 | A2 | 1/2005 |
| WO | 2005021022 | A2 | 3/2005 |
| WO | 2005102293 | A1 | 11/2005 |
| WO | 2006045796 | A2 | 5/2006 |
| WO | 2006068910 | A1 | 6/2006 |

(56) References Cited

FOREIGN PATENT DOCUMENTS

| | | | | |
|---|---|---|---|---|
| WO | 2006086769 | A2 | 8/2006 | |
| WO | 2006086769 | A3 | 8/2006 | |
| WO | 2006125763 | A1 | 11/2006 | |
| WO | 2007028633 | A2 | 3/2007 | |
| WO | 2008021560 | A2 | 2/2008 | |
| WO | 2008021560 | A3 | 2/2008 | |
| WO | 2008/081418 | A1 | 7/2008 | |
| WO | 2008/101017 | A2 | 8/2008 | |
| WO | 2009042922 | A2 | 4/2009 | |
| WO | 2009068910 | A1 | 6/2009 | |
| WO | 2009042922 | A3 | 11/2009 | |
| WO | 2010012495 | A1 | 2/2010 | |
| WO | 2010016935 | A2 | 2/2010 | |
| WO | 2010016936 | A1 | 2/2010 | |
| WO | 2010016938 | A2 | 2/2010 | |
| WO | 2010016940 | A2 | 2/2010 | |
| WO | 2010016944 | A2 | 2/2010 | |
| WO | 2011014680 | A2 | 2/2011 | |
| WO | 2011094337 | A1 | 8/2011 | |
| WO | 2012055770 | A1 | 5/2012 | |
| WO | 2012088116 | A2 | 6/2012 | |
| WO | 2012167744 | A1 | 12/2012 | |
| WO | 2015022420 | A1 | 2/2015 | |
| WO | 2015086853 | A1 | 6/2015 | |
| WO | 2015095354 | A2 | 6/2015 | |
| WO | 2015/185640 | A1 | 12/2015 | |
| WO | 2016/108654 | A1 | 7/2016 | |
| WO | 2016/209707 | A1 | 12/2016 | |
| WO | 2017074714 | A1 | 5/2017 | |
| WO | WO-2017112824 | A2 * | 6/2017 | ......... A61K 38/1703 |
| WO | 2018136440 | A1 | 7/2018 | |
| WO | 2018237095 | A1 | 12/2018 | |
| WO | 2018237097 | A1 | 12/2018 | |

OTHER PUBLICATIONS

Almind, K. et al., “Discovery of amino acid variants in the human glucose-dependent insulinotropic polypeptide (GIP) receptor: the impact on the pancreatic beta cell responses and functional expression studies in Chinese hamster fibroblast cells,” Diabetologia, 41:1194-1198 (1998).

Al-Sabah, Suleiman, “Molecular Pharmacology of the Incretin Receptors,” Medical Principles and Practice, 25(1):15-21 (2016).

Althage, M. C. et al., “Targeted Ablation of Glucose-dependent Insulinotropic Polypeptide-producing Cells in Transgenic Mice Reduces Obesity and Insulin Resistance Induced by a High Fat Diet,” The Journal of Biological Chemistry, 283(26) :18365-18376 (2008).

American Diabetes Association, Standards of Medical Care in Diabetes—2010, American Diabetes Association, Diabetes Care, 33(1):S11-S61 (2010).

Asmar, M. et al., “Glucose-Dependent Insulinotropic Polypeptide May Enhance Fatty Acid Re-esterification in Subcutaneous Abdominal Adipose Tissue in Lean Humans,” Diabetes, 59:2160-2163 (2010).

Ausubel, F. M. et al., eds., “Hybridization with Radioactive Probes, Using DNA Fragments as Probes,” Current Protocols in Molecular Biology, John Wiley & Sons, Inc., NY, Section II, Supplements Unit 6.3, pp. 6.3.1-6.3.6 (1989).

Ausubel, F. M. et al., eds., Brown, Terry, Contributor, “Hybridization Analysis of DNA Blots” Current Protocols in Molecular Biology, John Wiley and Sons, Inc., Chapter 2, Section IV, Supplements 21, 35, 29, 26, and 42, Unit 2.10 (2.10.1-2.10.16) (1993), Copyright (2000).

Ausubel, F. M. et al., eds., Duby, Allan, Jacobs, Kenneth A., Celeste, Anthony, Contributors, “Hybridization With Radioactive Probes, Using Synthetic Oligonucleotides as Probes,” Current Protocols in Molecular Biology, John Wiley and Sons, Inc., Chapter 6, Section II, Supplements 2, 13, and 9, Unit 6.4 (6.4.1-6.4.9) (1993), Copyright (2003).

Ausubel, F. M. et al., eds., Short Protocols in Molecular Biology, 2nd Edition, a Compendium of Methods from Current Protocols in Molecular Biology, Greene Publishing Associates and John Wiley and Sons, New York Chichester, Brisbane, Toronto (1992) (Table of Contents Only).

Ausubel, F. M. et al., eds., Strauss, William M., Contributor, “Hybridization With Radioactive Probes, Using DNA Fragments as Probes,” Current Protocols in Molecular Biology, John Wiley and Sons, Inc., Chapter 6, Section II, Supplements 24, 13, and 2, Unit 6.3 (6.3.1-6.3.6) (1993), Copyright (2003).

Baggio, L. L. et al., “Chronic exposure to GIP-1R agonists promotes homologous GLP-1 receptor desensitization in vitro but does not attenuate GLP-1R-dependent glucose homeostasis in vivo,” Diabetes, 53(3):S205-S214 (2004).

Beck, B. et al., “Direct metabolic effects of gastric inhibitory polypeptide (GIP): dissociation at physiological levels of effects on insulin-stimulated fatty acid and glucose incorporation in rat adipose tissue,” Diabetologia, 29:68 (1986).

Beck, B. et al., “Hypersensitivity of Adipose Tissue to Gastric Inhibitory Polypeptide Action in the Obese Zucker Rat,” Cellular and Molecular Biology, 33(5):555-562 (1987).

Behrens, C. R. et al., “Methods for Site-Specific Drug Conjugation to Antibodies,” mAbs, 6(1):46-53 (2014) (Downloaded by EPO Aug. 3, 2016).

Berndt, S. I. et al., “Genome-wide meta-analysis identifies 11 new loci for anthropometric traits and provides insights into genetic architecture,” Nature Genetics, 45(5):501-512 (2013).

Bhatnagar, P. K. et al., “Structure—Activity Relationships of Novel Hematoregulatory Peptides,” J. Med. Chem., 39:3814-3819 (1996).

Bianchi, A. A. and McGrew, J. T., “High-Level Expression of Full-Length Antibodies Using Trans-Complementing Expression Vectors,” Biotech Biotechnol. Bioeng., 84:439-444 (2003).

Bong, et al., “Chemoselective Pd(0)-catelyzed peptide coupling in water,” Organic Letters, 3(16):2509-2511 (2001).

Bootcov, M. R. et al., “MIC-1, a novel macrophage inhibitory cytokind, is a divergent member of the TGF-β superfamily,” Proc. Natl. Acad. Sci. USA, 94:11514-11519 (1997).

Bostrom, J., et al., “Improving antibody binding affinity and specificity for therapeutic development,” Methods Mol., Biol., 525:353-376 (2009).

Bowie, J. U. et al., “A Method to Identify Protein Sequences That Fold into a Known Three-Dimensional Structure,” Science, 253:164-170 (1991).

Boylan, M. O. et al., “Gastric inhibitory polypeptide immunoneutralization attenuates development of obesity in mice,” Am J Physiol Endocrinol Metab, 309 :E1008-E1018 (2015).

Branden, C. and Tooze, J., eds., Introduction to Protein Structure, Garland Publishing, Inc., New York and London (1991) (Table of Contents Only).

Brenner, S. E. et al., “Population statistics of protein structures: lessons from structural classifications,” Curr. Op. Struct. Biol., 7:369-376 (1997).

Brons, C. et al., “Impact of short-term high-fat feeding on glucose and insulin metabolism in young healthy men,” The Journal of Physiology, 587:2387-2397 (2009).

Bruggermann, M. et al., “Design Mice: the Production of Human Antibody Repertoires in Transgenic Animals,” Year in Immunol., 7:33-40 (1993).

Campbell, J. E. et al., “TCF1 links GIPR signaling to the control of beta cell function and survival,” Nature Medicine, 22(1):84-90 (2016).

Carrillo, H. et al., “The Multiple Sequence Alignment Problem in Biology,” Siam J. Applied Math, Society for Industrial and Applied Mathematics, 48(5):1073-1082 (1988).

Chalfie, M. et al., “Green Fluorescent Protein as a Marker for Gene Expression,” Science, 263:802-805 (1994).

Chamow, S. M. and Ashkenazi, A., “Immunoadhesins: principles and applications,” TIBTECH 14: 52-60 (1996).

Chen, J. et al., “Immunoglobulin gene rearrangement in B cell deficient mice generated by targeted deletion of the JH locus,” International Immunology, 5(6):647-656 (1993).

Cheung, R. C. et al., “Epitope-Specific Antibody Response to the Surface Antigen of Duck Hepatitis B Virus in Infected Ducks,” Virology, 176:546-552 (1990).

(56) References Cited

OTHER PUBLICATIONS

Chia, C. W. et al., "Exogenous Glucose-Dependent Insulinotropic Polypeptide Worsens Postprandial Hyperglycemia in Type 2 Diabetes," Diabetes, 58:1342-1349 (2009).
Chothia & Lesk, "Canonical Structures for the Hypervariable Regions of Immunoglobulins," J. Mol. Biol., 196:901-917 (1987).
Chothia, C. et al., "Conformations of immunoglobulin hypervariable regions," Nature, 342:877-883 (1989).
Chou, P. Y. et al., "Conformational Parameters for Amino Acids in Helical, β-Sheet, and Random Coil Regions Calculated from Proteins," Biochemistry, 13(2):211-222 (1974).
Chou, P. Y. et al., "Empirical Predictions of Protein Conformation," Ann. Rev. Biochem., 47:251-276 (1978).
Chou, P. Y. et al., "Prediction of Protein Conformation," Biochem., 13(2):222-245 (1974).
Chou, P. Y. et al., "Prediction of the Secondary Structure of Proteins From Their Amino Acid Sequence," Adv. Enzymol. Relat. Areas Mol. Biol., 47:45-148 (1978).
Chou, P. Y. et al., "Prediction of β-Turns," Biophys. J., 26:367-384 (1979).
Cinti, S. et al., "Adipocyte death defines macrophage localization and function in adipose tissue of obese mice and humans," Journal of Lipid Research, 46:2347-2355 (2005).
Coligan, J. E., ed., Current Protocols in Immunology, New York: John Wiley & Sons, Inc. (1993) (Table of Contents Only).
Cosman, D. et al., "Cloning, sequence and expression of human interleukin-2 receptor," Nature, 312:768-771 (1984).
Creighton, T. E., Ed., Proteins: Structures and Molecular Principles, 2nd ed., W. H. Freeman and Company, New York (1984) (Table of Contents Only).
Creighton, T. E., Ed., Proteins: Structures and Molecular Principles, W. H. Freeman and Company, San Francisco, CA, Section About: Hydroxylation of Pro and Lys, pp. 70-86 (1983).
Dayhoff, M. O. et al., Atlas of Protein Sequence and Structure, Chapter 22, a Model of Evolutionary Change in Proteins, 5(3):345-352 (1978).
Devasher, R. B. et al., "Aqueous-phase, palladium-catelyzed croscoupling of aryl bromides under mid conditions, using water-soluble, sterically demanding alkylphosphines," J. Org. Chem., 69:7919-7927 (2004).
Devereux, J. et al., "A comprehensive set of sequence analysis programs for the VAX," Nucl. Acid Res., Laboratory of Genetics, University of Wisconsin, Madison, WI, 12(1):387-395 (1984).
Dibowski, H. et al., Bioconjugation of peptides by palladium-catalyzed C—C cross-coupling in water, Angew. Chem. Int. Ed., 37(4):476-478 (1998).
Dillon, J. S. et al., "Cloning and functional expression of the human glucagon-like peptide-1 (GLP-1) receptor," Endocrinology, 133(4):1907-1910 (1993).
Drucker, D. J., "Enhancing incretin action for the treatment of type 2 diabetes," Diabetes Care, 26(10):2929-2940 (2003).
Eng et al., "Purification and Structure of Exendin-3, a New Pancreatic Secretagogue Isolated from Heloderma horridum Venom," The Journal of Biological Chemistry, 265(33):20259-202262 (1990).
Eppstein, D. A. et al., "Biological activity of liposomes-encapsulated murine interferon γ is mediated by a cell membrane receptor," Proc. Natl. Acad. Sci. USA 82:3688-3692 (1985).
Evans, B. E. et al., "Design of Nonpeptidal Ligands for a Peptide Receptor: Cholecystokinin Antagonists," J. Med. Chem., 30:1229-1239 (1987).
Fairlie, W. D., "Expression of a TGF-β superfamily protein, macrophage inhibitory cytokine-1, in the yeast Pichia pastoris," Gene, 254:67-76 (2000).
Falko, J. M. et al., "Gastric Inhibitory Polypeptide (GIP) Stimulated by Fat Ingestion in Man," JCE&M, 41(2):260-265 (1975).
Fauchere, J-L., "Elements for the Rational Design of Peptide Drugs," Adv. Drug Res., 15:29-69 (1986).
Fehmann, H. et al. "Cell and Molecular Biology of the Incretin Hormones Glucagon-Like Peptide-I and Glucose-Dependent Insulin Releasing Polypeptide," Endocrine Reviews, 16(3):390-410 (1995).
Finan, B. et al., "Emerging Opportunities for the Treatment of Metabolic Diseases: Glucagon-Like Peptide-1 Based Multi-Agonists," Molecular and Cellular Endocrinology, 418:42-54 (2015).
Finan, B. et al., "Unimolecular Dual Incretins Maximize Metabolic Benefits in Rodents, Monkeys, and Humans," Science-Translational Medicine, 5(209):209ra151 (2013).
Fishwild, D. M. et al., "High-avidity human IgGk monoclonal antibodies from a novel strain of minilocus transgenic mice," Nature Biotechnology, 14:845-851 (1996).
Fulurija, A. et al., "Vaccination against GIP for the Treatment of Obesity," Plos One, 3(9):e3163 (2008).
Gault, V. A. et al., "Characterization of the Cellular and Metabolic Effects of a Novel Enzyme-Resistant Antagonist of Glucose-Dependent Insulinotropic Polypeptide," Biochemical and Biophysical Research Communications, 290(5):1420-1426 (2002).
Genbank Accession No. U55762, "Cloning vector pEGFP-N1, complete sequence, enhanced green fluorescent protein (egfp) and neomycin phosphotransferase genes, complete cds," CLONTECH Labs, Inc., Kitts, P. A., (2003).
Gennaro, A. R., Remington's Pharmaceutical Sciences, 18th Edition, Mack Publishing Co., Easton, PA (1990) (Table of Contents Only).
Gerhard, D. S. et al., "The Status, Quality, and Expansion of the NIH Full-Length cDNA Project: The Mammalian Gene Collection (MGC)," Genome Research, 14:2121-2127 (2004).
Getty-Kaushik, L. et al., "Glucose-Dependent Insulinotropic Polypeptide Modulates Adipocyte Lipolysis and Reesterification," Obesity, 14(7):1124-1131 (2006).
Goding, Production of Monoclonal Antibodies, Monoclonal antibodies: principles and practice: production and application of monoclonal antibodies in cell biology, biochemistry, and immunology, pp. 59-103 (1986).
Goeddel, D. V., ed., Methods Enzymol., Gene Expression Technology, vol. 185, New York: Academic Press (1990) (Table of Contents Only).
Gonzalez, N.R., et al., "Minimizing the Immunogenicity of Antibodies for Clinical Application," Tumour Biol., 26(1):31-43 (2005).
Green, L. L. and Jakobovits, Aya, "Regulation of B Cell Development by Variable Gene Complexity in Mice Reconstituted with Human Immunoglobulin Yeast Artificial Chromosomes," J. Exp. Med., 188(3):483-495 (1998).
Green, L. L., et al., "Antigen-specific human monoclonal antibodies from mice engineered with human Ig heavy and light chain YACs," Nature Genetics, 7:13-21 (1994).
Gremlich, S. et al., "Cloning, Functional Expression, and Chromosomal Localization of the Human Pancreatic Islet Glucose-Dependent Insulinotropic Polypeptide Receptor," Diabetes, 44:1202-1208, (1995).
Gribskov, M. and Devereux, J., eds., Sequence Analysis Primer, New York: M. Stockton Press, (1991) (Table of Contents Only).
Gribskov, M. et al., "Profile Analysis, Searching Databases," Meth. Enzym., Chapter 9, 183:146-159 (1990).
Gribskov, M. et al., "Profile analysis: Detection of distantly related proteins," Proc. Nat. Acad. Sci. USA, 84:4355-4358 (1987).
Griffin, A. M. and Griffin, H. G., eds., Computer Analysis of Sequence Data, Part I, Humana Press, Totowa, New Jersey (1994) (Table of Contents Only).
Gupta, D. et al., "Physiologic and Pharmacologic Modulation of Glucose-Dependent Insulinotropic Polypeptide (GIP) Receptor Expression in β-Cells by Peroxisome Proliferator-Activated Receptor (PPAR)-γ Signaling: Possible Mechanism for the GIP Resistance in Type 2 Diabetes," Diabetes, 59:1445-1450 (2010).
Harding, F. A. and Lonberg, N., "Class Switching in Human Immunoglobulin Transgenic Mice," Ann. NY Acad. Sci., 765:536-546 (1995).
Hargrove, D. M. et al., "Biological activity of AC3174, a peptide analog of exendin-4," Regulatory Peptides, 141:113-119 (2007).

(56) References Cited

OTHER PUBLICATIONS

Harlow, E. and Lane, D., Antibodies: a Laboratory Manual, Cold Spring Harbor Laboratory Press, Cold Spring Harbor, NY (1988) (Ed. 1991 and Periodic Supplements) (Table of Contents Only).
Haugland, R. P., Molecular Probes Handbook, a Guide to Fluorescent Probes and Labeling Technologies, 11th Ed. Invitrogen by ThermoFisher Scientific (2010) (Table of Contents Only).
Hauner, H. et al., “Effects of Gastric Inhibitory Polypeptide on Glucose and Lipid Metabolism of Isolated Rat Adipocytes,” Ann. Nutr. Metab., 32:282-288 (1988).
Heim, R. et al., “Engineering green fluorescent protein for improved brightness, longer wavelengths and fluorescence resonance energy transfer,” Current Biology, 6:178-182 (1996).
Henikoff, S. et al., “Amino acid substitution matrices from protein blocks,” Proc. Natl. Acad. Sci. USA, 89:10915-10919 (1992).
Hinke, S. A. et al., Identification of a bioactive domain in the amino-terminus of glucose-dependent insulinotropic polypeptide (GIP), Biochimica et Biophysica Acta, 1547(1):143-155 (2001).
Højberg, P. V. et al., “Four weeks of near-normalisation or blood glucose improves the insulin response to glucagon-like peptide-1 and glucose-dependent insulinotropic polypeptide in patients with type 2 diabetes,” Diabetologia, 52:199-207 (2009).
Holm, L. et al., “Protein folds and families: sequence and structure alignments,” Nucleic Acid Research, 27(1):244-247 (1999).
Hoogenboom et al., “By-passing Immunisation Human Antibodies from Synthetic Repertoires of Germline VH Gene Segments Rearranged in Vitro,” J. Mol. Biol., 227:381-388 (1991).
Hopp, T. P. et al., “A Short Polypeptide Marker Sequence Useful for Recombinant Protein Identification and Purification,” Bio/Technology, 6:1204-1210 (1988).
Ichiki, T. et al., “Regulation of the expression of human C epsilon germline transcript. Identification of a novel IL-4 responsive element,” The Journal of Immunology, 150:5408-5417 (1993).
Inagaki, N. et al., “Gastric Inhibitory Polypeptide: Structure and Chromosomal Localization of the Human Gene,” Molecular Endocrinology 3(6):1014-1021 (1989).
International Search Report for PCT/US2016/068138, dated Jun. 19, 2017, 14 pages.
International Search Report for PCT/US2018/013918, dated Jun. 5, 2018, 8 pages.
International Search Report for PCT/US2018/038638, dated Oct. 22, 2018, 7 pages.
International Search Report for PCT/US2018/038634, dated Nov. 19, 2018, 10 pages.
Jakobovits, A. et al., “Analysis of homozygous mutant chimeric mice: deletion of the immunoglobulin heavy-chain joining region blocks B-cell development and antibody production,” Proc. Natl. Acad. Sci. USA, 90:2551-2555 (1993).
Jakobovits, A. et al., “Germ-line transmission and expression of a human-derived yeast artificial chromosome,” Nature, 362:255-258 (1993).
Jalkanen, M. et al., “Cell Surface Proteoglycan of Mouse Mammary Epithelial Cells is Shed by Cleavage of Its Matrix-binding Ectodomain from Its Membrane-associated Domain,” The Journal of Cell Biology, 105(6)(2):3087-3096 (1987).
Jalkanen, M. et al., “Heparan Sulfate Proteoglycans from Mouse Mammary Epithelial Cells: Localization on the Cell Surface with a Monoclonal Antibody,” The Journal of Cell Biology, 101:976-984 (1985).
Jones, D. T. et al., “Progress in protein structure prediction,” Current Opinion in Structural Biology, 7:377-387 (1997).
Jones, P. T. et al., “Replacing the complementarity-determining regions in a human antibody with those from a mouse,” Nature, 321:522-525 (1986).
Joo, E. et al., “Inhibition of Gastric Inhibitory Polypeptide Receptor Signaling in Adipose Tissue Reduces Insulin Resistance and Hepatic Steatosis in High-Fat Diet-Fed Mice,” Diabetes, 66:868-879 (2017).
Kabat, E. A. et al., Sequences of Proteins of Immunological Interest, 5th ed., U.S. Dept. of Health and Human Services, PHS, NIH, Bethesda, MD (1987 and 1991) (Table of Contents Only).
Kabat, E. A. et al., Sequences of Proteins of Immunological Interest, 5th ed., U.S. Dept. of Health and Human Services, PHS, NIH, NIH Publication No. 91-3242, Bethesda, MD (1991) (Table of Contents Only).
Kellerman, S. and Green, L. L., “Antibody discovery: the use of transgenic mice to generate human monoclonal antibodies for therapeutics,” Current Opinion in Biotechnology, 13:593-597 (2002).
Kennett, R. H. et al., eds., Monoclonal Antibodies, Hybridomas: a New Dimension in Biological Analyses, Plenum Press, New York (1980) (Table of Contents Only).
Kilpatrick, K. E. et al., “Rapid development of affinity matured monoclonal antibodies using RIMMS,” Hybridoma, 16(4):381-389 (1997).
Kim, S. J. et al., “Activation of Lipoprotein Lipase by Glucose-dependent Insulinotropic Polypeptide in Adipocytes: a Role for a Protein Kinase B, LKB1, and AMP-Activated Protein Kinase Cascade,” The Journal of Biological Chemistry, 282(12):8557-8567 (2007).
Kim, S. J. et al., “GIP-Overexpressing Mice Demonstrate Reduced Diet-Induced Obesity and Steatosis, and Improved Glucose Homeostasis,” Plos One, 7(7):e40156 (2012).
Kirkland, T. N. et al., “Analysis of the Fine Specificity and Cross-Reactivity of Monoclonal Anti-Lipid A Antibodies,” The Journal of Immunology, 137(11):3614-3619 (1986).
Knapper, J. M. et al., “Investigations into the Actions of Glucose-Dependent Insulinotropic Polypeptide and Glucagon-Like Peptide-1(7-36)amide on Lipoprotein Lipase Activity in Explants of Rat Adipose Tissue,” The Journal of Nutrition, 125(2):183-188 (1995).
Kostelny, S. A. et al., “Formation of a Bispecific Antibody by the Use of Leucine Zippers,” The Journal of Immunology, 148(5):1547-1553 (1992).
Kyte, J. et al., “A Simple Method for Displaying the Hydropathic Character of a Protein,” J. Mol. Biol., 157:105-132 (1982).
Langer, R. et al., “Biocompatibility of polymeric delivery systems for macromolecules,” Journal of Biomedical Materials. Research, 15:267-277 (1981).
Langer, R. et al., “Controlled release of macromolecules,” Chem. Tech., 12:98-105 (1982).
Lesk, A. M., ed., Computational Molecular Biology, Sources and Methods for Sequence Analysis, New York: Oxford University Press, Oxford New York Tokyo (1988) (Table of Contents Only).
Lewis, J. T. et al. “Glucose-dependent insulinotropic polypeptide confers early phase insulin release to oral glucose in rats: demonstration by a receptor antagonist”, Endocrinology, 141(10): 3710-3716 (2000).
Link, A. J. et al., “Non-canonical amino acids in protein engineering,” Current Opinion in Biotechnology, 14(6):603-609 (2003).
Lonberg, N. and Huszar, D., “Human Antibodies from Transgenic Mice,” Intern. Rev. Immunol., 13:65-93 (1995).
Lonberg, N. et al., “Antigen-specific human antibodies from mice comprising four distinct genetic modifications,” Nature, 368:856-859 (1994).
Lonberg, N. et al., The Pharmacology of Monoclonal Antibodies—Chapter 3: “Transgenic Approaches to Human Monoclonal Antibodies,” Handbook of Exp. Pharmacology, 113:49-101 (1994).
Lorenz, M. et al., “Recent progress and future options in the development of GLP-1 receptor agonists for the treatment of diabesity,” Bioorg Med Chem Lett, 23(14):4011-4018 (2013).
Lund, A. et al., “The separate and combined impact of the intestinal hormones, GIP, GLP-1, and GLP-2, on glucagon secretion in type 2 diabetes,” Am J Physiol Endocrinol Metab, 300:E1038-E1046 (2011).
Manandhar, B. and Ahn, J., “Glucagon-like Peptide 1 (GLP-1) Analogs: Recent Advances, New Possibilities, and Therapeutic Implications,” J. Med. Chem., 58(3):1020-1037 (2015).
Maniatis et al., “Regulation of Inducible and Tissue-Specific Gene Expression,” Science, 236:1237-1244 (1987).
Marks, J. D. et al., “By-passing Immunization: Human Antibodies and V-gene Libraries Displayed on Phage,” J. Mol. Biol., 222:581-597 (1991).
Meier, J. J. et al., “Gastric inhibitory polypeptide (GIP) dose-dependently stimulates glucagon secretion in healthy human subjects at euglycaemia,” Diabetologia, 46:798-801 (2003).

(56) References Cited

OTHER PUBLICATIONS

Mendez et al., "Functional transplant of megabase human immunoglobulin loci recapitulates human antibody response in mice," Nature Genetics, 15:146-156 (1997).
Miyawaki, K. et al., "Inhibition of gastric inhibitory polypeptide signaling prevents obesity," Nature Medicine, 8(7):738-742 (2002).
Mohammad, S. et al., "A Naturally Occurring GIP Receptor Variant Undergoes Enhanced Agonist-Induced Desensitization, Which Impairs GIP Control of Adipose Insulin Sensitivity," Molecular and Cellular Biology, 34(19):3618-3629 (2014).
Moldenhauer, G. et al., "Identity of HML-1 Antigen on Intestinal Intraepithelial T Cells and of B-ly7 Antigen on Hairy Cell Leukaemia," Scand. J. Immunol., 32:77-82 (1990).
Montgomery, I. A. et al., "Active immunization against (Pro(3))GIP improves metabolic status in high-fat-fed mice," Diabetes, Obesity & Metabolism, pp. 744-751 (2010).
Morel et al., "Monoclonal Antibodies to Bovine Serum Albumin: Affinity and Specificity Determinations," Molecular Immunology, 25(1):7-15 (1988).
Morrison, S. L. et al., "Chimeric human antibody molecules: Mouse antigen-binding domains with human constant region domains," Proc. Natl. Acad. Sci. USA, 81:6851-6855 (1984).
Moult, J. et al., "The current state of the art in protein structure prediction," Current Opinion in Biotechnology, 7:422-427 (1996).
Murphy, M. C. et al., "Postprandial lipid and hormone responses to meals of varying fat contents: modulatory role of lipoprotein lipase?," European Journal of Clinical Nutrition, 49:579-588 (1995).
Nasteska, D. et al., "Chronic Reduction of GIP Secretion Alleviates Obesity and Insulin Resistance Under High-Fat Diet Conditions," Diabetes, 63:2332-2343 (2014).
Nauck, M. A. et al., "Preserved Incretin Activity of Glucagon-like Peptide 1 [7-36 Amide] but Not of Synthetic Human Gastric Inhibitory Polypeptide in Patients with Type-2 Diabetes Mellitus," J. Clinic. Invest., 91:301-307 (1993).
NCBI Reference Sequence: AAI20674, https://www.ncbi.nlm.nih.gov/sviewer/viewer.fcgi?db=nuccore&val=AAI20674&report=genbank) (downloaded Nov. 28, 2017).
NCBI Reference Sequence: NM_000164, https://www.ncbi.nlm.nih.gov/sviewer/viewer.fcgi?noredirect=1&db=nuccore&val=NM_000164.1, (downloaded Nov. 28, 2017).
NCBI Reference Sequence: NM_001080815, https://www.ncbi.nlm.nih.gov/sviewer/viewer.fcgi?db=protein&val=NM_001080815&report=genbank, (downloaded Nov. 28, 2017).
NCBI Reference Sequence: NP_000155, https://www.ncbi.nlm.nih.gov/protein/NP_000155.1 (downloaded Aug. 16, 2018).
NCBI Reference Sequence: NP_001074284, https://www.ncbi.nlm.nih.gov/sviewer/viewer.fcgi?db=protein&val=NP_001074284+&report=genbank, (downloaded Nov. 28, 2017).
NCBI Reference Sequence: XP_005258790, https://www.ncbi.nlm.nih.gov/sviewer/viewer.fcgi?db=nuccore&val=XP_005258790&report=genbank, (downloaded Nov. 28, 2017).
Needleman, S. B. et al., Algorithm, "A General Method Applicable to the Search for Similarities in the Amino Acid Sequence of Two Proteins," J. Mol. Biol., 48:443-453 (1970).
Nielsen, L. L. et al., "Pharmacology of exenatide (synthetic exendin-4) for the treatment of type 2 diabetes," Current Opinion in Investigational Drugs, 4(4):401-405 (2003).
Nolan, G. P. et al., "Flourescence-activated cell analysis and sorting of viable mammalian cells based on beta-D-galactosidase activity after transduction of *Escherichia coli* lacZ," Proc. Natl. Acad. Sci. USA, 85:2603-2607 (1988).
Okada, Y. et al., "Common variants at CDKAL1 and KLF9 are associated with body mass index in east Asian populations," Nature Genetics, 44(3):302-306 (2012).
Paul, W. E. et al., Fundamental Immunology, 2nd ed., Chapter 7: Evolution of the Immune System, pp. 139-165, Raven Press, New York (1989).
Prasad-Reddy, L. et al., "A clinical review of GLP-1 receptor agonists: efficacy and safety in diabetes and beyond," Drugs in Context, 4:212283 (2015).
Prescher, J. A., and Bertozzi, C. R., Chemistry in living systems, Nature Chemical Biology, 1(1):13-21 (2005).
Raufman, J. P. et al., "Truncated Glucagon-like Peptide-1 Interacts with Exendin Receptors on Dispersed Acini from Guinea Pig Pancreas," The Journal of Biological Chemistry, 265(30):21432-21437 (1992).
Ravn, P. et al., "Structural and Pharmacological Characterization of Novel Potent and Selective Monoclonal Antibody Antagonists of Glucose-dependent Insulinotropic Polypeptide Receptor," The Journal of Biological Chemistry, 288(27):19760-19772, (2013).
Riechmann, L. et al., "Reshaping human antibodies for therapy," Nature, 332(24):323-327 (1988).
Rizo, J. and Gierasch, L. M., "Constrained Peptides: Models of Bioactive Peptides and Protein Substructures," Annual Rev. Biochem., 61:387-418 (1992).
Rudikoff, S. et al., "Single amino acid substitution altering antigen-binding specificity," Proc. Natl. Acad. Sci., 79:1979-1983 (1982).
Sambrook, J. et al., Molecular Cloning: a Laboratory Manual, 2nd ed., Cold Spring Harbor Laboratory Press (1989) (Table of Contents Only).
Sambrook, J. et al., Molecular Cloning: a Laboratory Manual, 3rd ed., Cold Spring Harbor Laboratory Press, Cold Spring Harbor, NY (2001) (Table of Contents Only).
Saxena, R. et al., "Genetic variation in GIPR influences the glucose and insulin responses to an oral glucose challenge," Nature Genetics, 42(2):142-148 (2010).
Schumacher, D. et al., "Current Status: Site-Specific Antibody Drug Conjugates," Journal of Clinical Immunology, 36(1):100-107 (2016).
Shinmi, D. et al., "One-Step Conjugation Method for Site-Specific Antibody-Drug Conjugates through Reactive Cysteine-Engineered Antibodies," Bioconjugate Chem, 27(5):1324-1331 (2016).
Sidman, K. R. et al., "Controlled Release of Macromolecules and Pharmaceuticals from Synthetic Polypeptides Based on Glutamic Acid," Biopolymers, 22:547-556 (1983).
Sippl, Manfred J. et al., "Threading thrills and threats," Structure, 4:15-19 (1996).
Smith, D. W., ed., Biocomputing Informatics and Genome Projects, New York: Academic Press (1994) (Table of Contents Only).
Songsivilai, S. and Lachmann, P. J., "Bispecific antibody: a tool for diagnosis and treatment of disease," Clin. Exp. Immunol., 79:315-321 (1990).
Speliotes, E. K. et al., "Association analyses of 249,796 individuals reveal 18 new loci associated with body mass index," Nature Genetics, 42(11):937-948 (2010).
Stahli, C. et al., "Distinction of Epitopes by Monoclonal Antibodies," Methods in Enzymology, 92:242-253 (1983).
Stauber, R. H., "Developments and Applications of Enhanced Green Fluorescent Protein Mutants," BioTechniques, 24(3):462-471 (1998).
Strissel, K. J. et al., "Adipocyte Death, Adipose Tissue Remodeling, and Obesity Complications," Diabetes, 56:2910-2918 (2007).
Suzuki, K. et al., "Transcriptional Regulatory Factor X6 (Rfx6) Increases Gastric Inhibitory Polypeptide (GIP) Expression in Enteroendocrine K-cells and Is Involved in GIP Hypersection in High Fat Diet-induced Obesity," The Journal of Biological Chemistry, 288(3):1929-1938 (2013).
Taylor, L. D. et al., "A Transgenic mouse that expresses a diversity of human sequence heavy and light chain immunoglobulins," Nucleic Acids Research, 20(23):6287-6295 (1992).
Taylor, L. D. et al., "Human immunoglobulin transgenes undergo rearrangement, somatic mutation and class switching in mice that lack endogenous IgM," International Immunology, 6(4):579-591 (1994).
Third Report of the National Cholesterol Education Program (NCEP) Expert Panel on Detection, Evaluation, and Treatment of the High Blood Cholesterol in Adults (adult Treatment Panel III) Final Report, National Institutes of Health, NIH Publication No. 02-5215 (2002).
Thornton, J. M. et al., "Prediction of progress at last," Nature, 354:105-106 (1991).
Tijssen, Practice and Theory of Enzyme Immunoassays, R. H. Burdon and P. H. van Knippenberg, Eds, Elsevier, Amsterdam, vol. 15 (1993) (Table of Contents Only).

(56) References Cited

OTHER PUBLICATIONS

Trumper, A. et al., "Glucose-Dependent Insulinotropic Polypeptide Is a Growth Factor for β (INS-1) Cells by Pleiotropic Signaling," Molecular Endocrinology, 15(9):1559-1570 (2001).
Tseng, C. C. et al., "Regulation of glucose-dependent insulinotropic peptide gene expression by a glucose meal," Am J Physiol, 266(5)(1):G887-891 (1994).
Tsubamoto, Y. et al., "A novel low-molecular-weight antagonist of glucose-dependent insulinotropic polypeptide receptor SKL-14959, prevents obesity and insulin resistance," Diabetologia, 51:S373 (2008).
Tuaillon et al., "Biased utilization of DHQ52 and JH4 gene segments in a human Ig transgenic minilocus is independent of antigenic selection," The Journal of Immunology, 152:2912-2920 (1994).
UniProtKB Sequence Identifier: P48546-2, http://www.uniprot.org/uniprot/P48546-2.fasta, downloaded Nov. 30, 2017.
UniprotKB/Swiss-Prot Q0P543-1, http://www.uniprot.org/uniprot/Q0P543.fasta, downloaded Dec. 4, 2017.
Usdin, T. B. et al., "Gastric Inhibitory Polypeptide Receptor, a Member or the Secretin-Vasoactive Intestinal Peptide Receptor Family, Is Widely Distributed in Peripheral Organs and the Brain," Endocrinology, 133(6):2861-2870 (1993).
Van Heeke, G. & Schuster, S. M., "Expression of Human Asparagine Synthetase in *Escherichia coli*," The Journal of Biological Chemistry, 264(10):5503-5509 (1989).
Vassilatis et al., "The G Protein-coupled receptor repertoires of human and mouse," PNAS USA, 100(8):4903-4908 (2003).
Veber, D. F. and Freidinger, R. M., "The design of metabolically-stable peptide analogs," TINS, p. 392-396 (1985).
Verhoeyen, M. et al., "Reshaping Human Antibodies: Grafting an Antilysozyme Activity," Science, 239:1534-1536 (1988).
Vilsboll, T. et al., "Incretin Secretion in Relation to Meal Size and Body Weight in Healthy Subjects and People with Type 1 and Type 2 Diabetes Mellitus," The Journal of Clinical Endocrinology & Metabolism, 88(6):2706-2713 (2003).
Volz, A. et al., "Molecular cloning, functional expression, and signal transduction of the GIP-receptor cloned from a human insulinoma," FEBS Letters, 373:23-29 (1995).
Von Heinje, G., Sequence Analysis in Molecular Biology, Academic Press, Inc., New York (1987) (Table of Contents Only).
Voss, S. D. et al., "The role of enhancers in the regulation of cell-type-specific transcriptional control," TIBS, 11:287 (1986).
Wang, Y. et al., "Multifunctional Antibody Agonists Targeting Glucagon-like Peptide-1, Glucagon, and Glucose-Dependent Insulinotropic Polypeptide Receptors," Angewandte Chemie International Edition, 55(40): 12475-12478 (2016).
Wang, Y. J. and Hanson, M. A. et al., "Parenteral Formulations of Proteins and Peptides: Stability and Stabilizers," Journal of Parenteral Science and Technology, Technical Report No. 10, 42(2S): S4-S26 (1988).
Wen, W. et al., "Meta-analysis identifies common variants associated with body mass index in east Asians," Nature Genetics, 44(3):307-311 (2012).
Western, E. C. (Including Shaugnessy, K. H. as shown in specification) et al., "Efficient One-Step Suzuki Arylation of Unprotected Halonucleosides, Using Water-Soluble Palladium Catalysts," J. Org. Chem., 68:6767-6774 (2003).
Written Opinion for PCT/US2016/068138, dated Jun. 19, 2017, 17 pages.
Written Opinion for PCT/US2018/013918, dated Jun. 5, 2018, 8 pages.
Written Opinion for PCT/US2018/038638, dated Oct. 22, 2018, 11 pages.
Written Opinion for PCT/US2018/038634, dated Nov. 19, 2018, 12 pages.
Wu, H., et al., "Humanization of a Murine Monoclonal Antibody by Simultaneous Optimization of Framework and CDR Residues," J. Mol. Biol., 294: 151-162 (1999).
Yamada, Y. et al., "Pancreatic and Extrapancreatic Effects of Gastric Inhibitory polypeptide," Diabetes, 55(2):S86-S91 (2006).
Yip, R. G. et al., "Functional GIP Receptors are Present on Adipocytes," Endocrinology, 139(9):4004-4007 (1998).
Yutaka, S. et al., "Glucose-dependent insulinotropic polypeptide and glucagon-like peptide-1: Incretin actions beyond the pancreas", Journal of Diabetes Investigation, 4(2):108-130 (2013).
Zola, H., Monoclonal Antibodies: a Manual of Techniques, "Using Monoclonal Antibodies: Soluble Antigens," CRC Press, Inc., Chapter 6, pp. 147-181 (1987).
Bork, "Powers and pitfalls in sequence analysis: the 70% hurdle," Genome Research, 10:398-400 (2000).
Brown et al., "Tolerance of single, but not multiple, amino acid replacements in antibody VH CDR 2: a means of minimizing B cell wastage from somatic hypermutation?," J. Immunol. 156(9):3285-91 (1996).
Burgess et al., Possible dissociation of the heparin-binding and mitogenic activities of heparin-binding (acidic fibroblast) growth factor-1 from its receptor-binding activities by site-directed mutagenesis of a single lysine residue, J. Cell Biol., 111:2129-39 (1990).
Miosge et al., "Comparison of predicted and actual consequences of missense mutations," PNAS, 112(37):E5189-98 (2015).
Skolnick et al., "From genes to protein structure and function: novel applications of computational approaches in the genomic era," Trends Biotechnol. 18(1):34-9 (2000).
Vajdos et al., "Comprehensive functional maps of the antigen-binding site of an anti-ErbB2 antibody obtained with shotgun scanning mutagenesis," J. Mol. Biol. 320(2):415-28 (2002).
Crofts et al., "Hyperinsulinemia: Best management practice", Diabesity, vol. 2 (1):1-11 (2016).
De La Lastra et al., "Epitope mapping of 10 monoclonal antibodies against the pig analogue of human membrane cofactor protein (MCP)", Cancer research, 96(4):663-70 (1999).
Klein et al., Epitope interactions of monoclonal targeting CD20 and their relationship to functional properties mAbs, 5(1):22-33 (2013).
Pamir et al., "Glucose-dependent insulinotropic polypeptide receptor null mice exhibit compensatory changes in the enteroinsular axis," Am J Physiol: Endocrinol Metab, 284(5):E931-E9 (2003).

* cited by examiner

METHOD OF TREATING OR AMELIORATING METABOLIC DISORDERS USING BINDING PROTEINS FOR GASTRIC INHIBITORY PEPTIDE RECEPTOR (GIPR) IN COMBINATION WITH GLP-1 AGONISTS

This application is a national stage application under 35 U.S.C. § 371 of International Application No. PCT/US2018/038638, having an international filing date of 20 Jun. 2018, which claims the benefit of U.S. Provisional Patent Application No. 62/522,559, filed 20 Jun. 2017, each of which is incorporated herein by reference in its entirety.

SEQUENCE LISTING

The instant application contains a Sequence Listing which has been submitted electronically in ASCII format and is hereby incorporated by reference in its entirety. Said ASCII copy, created on Dec. 16, 2018, is named A-2164-US-PCT_FINAL_SEQUENCE_LISTING_121619.txt and is 1,100 kilobytes in size.

FIELD OF THE INVENTION

The present disclosure relates to the treatment or amelioration of a metabolic disorder, such as type 2 diabetes, elevated glucose levels, elevated insulin levels, obesity, non-alcoholic fatty liver disease, or cardiovascular diseases, using an antigen binding protein specific for the gastric inhibitory peptide receptor (GIPR).

BACKGROUND OF THE INVENTION

Glucose-dependent insulinotropic polypeptide (GIP) is a single 42-amino acid peptide secreted from K-cells in the small intestine (duodenum and jejunum). Human GIP is derived from the processing of proGIP, a 153-amino acid precursor that is encoded by a gene localized to chromosome 17q (Inagaki et al., Mol Endocrinol 1989; 3:1014-1021; Fehmann et al. Endocr Rev. 1995; 16:390-410). GIP was formerly called gastric inhibitory polypeptide.

GIP secretion is induced by food ingestion. GIP has a number of physiological effects in tissues, including promotion of fat storage in adipocytes and promotion of pancreatic islet β-cell function and glucose-dependent insulin secretion. GIP and glucagon like polypeptide-1 (GLP-1) are known insulinotropic factors ("incretins"). Intact GIP is rapidly degraded by DPPIV to an inactive form. The insulinotropic effect of GIP is lost in type 2 diabetic patients while GLP-1's incretin effect remains intact (Nauck et al. J. Clinc. Invest. 1993; 91:301-307).

The GIP receptor (GIPR) is a member of the secretin-glucagon family of G-protein coupled receptors (GPCRs) having an extracellular N-terminus, seven transmembrane domains and an intracellular C-terminus. The N-terminal extracellular domains of this family of receptors are usually glycosylated and form the recognition and binding domain of the receptor. GIPR is highly expressed in a number of tissues, including the pancreas, gut, adipose tissue, heart, pituitary, adrenal cortex, and brain (Usdin et al., Endocrinology. 1993, 133:2861-2870). Human GIPR comprises 466 amino acids and is encoded by a gene located on chromosome 19q13.3 (Gremlich et al., Diabetes. 1995; 44:1202-8; Volz et al., FEBS Lett. 1995, 373:23-29). Studies have suggested that alternative mRNA splicing results in the production of GIP receptor variants of differing lengths in human, rat and mouse.

GIPR knockout mice ($Gipr^{-/-}$) are resistant to high fat diet-induced weight gain and have improved insulin sensitivity and lipid profiles. (Yamada et al., Diabetes. 2006, 55:S86; Miyawaki et al. Nature Med. 2002, 8:738-742). In addition, a novel small molecule GIPR antagonist SKL-14959 prevents obesity and insulin resistance. (Diabetologia 2008, 51:S373, 44th EASD Annual meeting poster).

Glucagon-like peptide-1 ("GLP-1") is a 31-amino acid peptide derived from the proglucagon gene. It is secreted by intestinal L-cells and released in response to food ingestion to induce insulin secretion from pancreatic β-cells (Diabetes 2004, 53:S3, 205-214). In addition to the incretin effects, GLP-1 also decreases glucagon secretion, delays gastric emptying and reduces caloric intake (Diabetes Care, 2003, 26(10): 2929-2940). GLP-1 exerts its effects by activation of the GLP-1 receptor, which belongs to a class B G-protein-coupled receptor (Endocrinology. 1993, 133(4):1907-10). The function of GLP-1 is limited by rapid degradation by the DPP-IV enzyme, resulting in a half-life of approximately 2 minutes. Recently, long-lasting GLP-1 receptor agonists such as exenatide, liraglutide, dulaglutide have been developed and are now being used clinically to improve glycemic control in patients with type 2 diabetes. Furthermore, GLP-1 receptor agonists also promote body weight reduction as well as reduction in blood pressure and plasma cholesterol levels in patients (Bioorg. Med. Chem. Lett 2013, 23:4011-4018).

Collectively, these links to obesity and insulin resistance imply GIPR inhibition is a useful approach for therapeutic intervention, both as a monotherapy and in combination with GLP-1.

SUMMARY OF THE INVENTION

In one aspect, the present disclosure provides a method of treating a subject with a metabolic disorder, the method comprising administering to the subject a therapeutically effective amount of an antigen binding protein that specifically binds to a protein having an amino acid sequence having at least 90% amino acid sequence identity to an amino acid sequence of a GIPR. In one aspect the present invention is directed to a method of treating a subject with a metabolic disorder, the method comprising administering to the subject a therapeutically effective amount of a GLP-1 receptor agonist and a therapeutically effective amount of a GIPR antagonist that specifically binds to a protein having an amino acid sequence having at least 90% amino acid sequence identity to an amino acid sequence of a GIPR. In one embodiment, the metabolic disorder is a disorder of glucose metabolism. In another embodiment, the glucose metabolism disorder comprises hyperglycemia and administering the antigen binding protein reduces plasma glucose. In another embodiment, the glucose metabolism disorder comprises hyperinsulinemia and administering the antigen binding protein reduces plasma insulin. In another embodiment, the glucose metabolism disorder comprises glucose intolerance and administering the antigen binding protein reduces increases glucose tolerance. In another embodiment, the glucose metabolism disorder comprises insulin resistance and administering the antigen binding protein reduces insulin resistance. In another embodiment, the glucose metabolism disorder comprises diabetes mellitus. In another embodiment, the subject is obese. In another embodiment, administering the antigen binding protein reduces body weight in an obese subject. In another embodiment, administering the antigen binding protein reduces body weight gain in an obese subject. In another embodiment, administering the antigen binding protein reduces fat mass in an obese subject. In another embodiment, the glucose metabolism disorder comprises insulin resistance and administering the antigen binding protein reduces insulin resistance in an obese subject. In another embodiment, administering the antigen binding protein reduces liver steatosis in an obese subject having increased liver steatosis. In another embodiment, administering the antigen binding protein reduces liver fat content in an obese subject having increased liver fat content.

In one aspect the present invention is directed to a method of treatment comprising administering to a subject a therapeutically effective amount of at least one GLP-1 receptor agonist in combination with administration of at least one GIPR antagonist which upon administration to a subject with symptoms of a metabolic disorder provides sustained beneficial effects.

In one embodiment, administration of at least one GLP-1 receptor agonist in combination with administration of at least one GIPR antagonist provides sustained beneficial effects of at least one symptom of a metabolic disorder.

In one embodiment, the therapeutically effective amounts of the GLP-1 receptor agonist and the GIPR antagonist are combined prior to administration to the subject.

In one embodiment, the therapeutically effective amounts of the GLP-1 receptor agonist and the GIPR antagonist are administered to the subject sequentially.

In one embodiment, the therapeutically effective amounts of a GLP-1 receptor agonist and a GIPR antagonist are synergistically effective amounts.

In one embodiment, the molar ratio of a GLP-1 receptor agonist to a GIPR antagonist is from about 1:1 to 1:110, 1:1 to 1:100, 1:1 to 1:75, 1:1 to 1:50, 1:1 to 1:25, 1:1 to 1:10, 1:1 to 1:5, and 1:1. In one embodiment, the molar ratio of a GIPR antagonist to a GLP-1 receptor agonist is from about 1:1 to 1:110, 1:1 to 1:100, 1:1 to 1:75, 1:1 to 1:50, 1:1 to 1:25, 1:1 to 1:10, or 1:1 to 1:5.

In one embodiment, the GLP-1 receptor agonist is used in combination with the GIPR antagonist at therapeutically effective molar ratios of between about 1:1.5 to 1:150, preferably 1:2 to 1:50.

In one embodiment, the GLP-1 receptor agonist and the GIPR antagonist are present in doses that are at least about 1.1 to 1.4, 1.5, 2, 3, 4, 5, 6, 7, 8, 9, or 10 fold lower than the doses of each compound alone required to treat a condition and/or disease.

In one embodiment, the GLP-1 receptor agonist is GLP-1(7-37) or a GLP-1(7-37) analog.

In one embodiment, the GLP-1 receptor agonist is selected from the group consisting of exenatide, liraglutide, lixisenatide, albiglutide, dulaglutide, semaglutide, and taspoglutide.

In one embodiment, the GLP-1 receptor agonist is selected from the group consisting of GLP-1(7-37) (SEQ ID NO: 1244): GLP-1(7-36)-$NH_2$(SEQ ID NO: 1245); liraglutide; albiglutide; taspoglutide; dulaglutide, semaglutide; LY2428757; desamino-His$^7$,Arg$^{26}$,Lys$^{34}$(N$^\varepsilon$-(γ-Glu(N-α-hexadecanoyl)))-GLP-1(7-37) (core peptide disclosed as SEQ ID NO; 1282); desamino-His$^7$,Arg$^{26}$,Lys$^{34}$(N$^\varepsilon$-octanoyl)-GLP-1(7-37) (SEQ ID NO. 1283); Arg$^{26,34}$,Lys$^{38}$(N$^\varepsilon$-(ω-carboxypentadecanoyl))-GLP-1(7-38) (SEQ ID NO: 1284); Arg$^{26,34}$,Lys$^{36}$(N$^\varepsilon$-(γ-Glu(N-α-hexadecanoyl)))-GLP-1(7-36) (core peptide disclosed as SEQ ID NO: 1285): Aib$^{8,35}$,Arg$^{26,34}$,Phe$^{31}$-GLP-1(7-36)) (SEQ ID NO: 1246): HXaa$_8$EGTFTSDVSSYLEXaa$_{22}$Xaa$_{23}$AAKEFIXaa$_{30}$ WLXaa$_{33}$Xaa$_{34}$G Xaa$_{36}$Xaa$_{37}$: wherein Xaa$_3$ is A, V, or G; Xaa$_{22}$ is G, K, or E; Xaa$_{23}$ is Q or K; Xaa$_{30}$ is A or E; Xaa$_{33}$ is V or K; Xaa$_{34}$ is K, N, or R; Xaa$_{36}$ is R or G; and Xaa$_{37}$ is G, H, P, or absent (SEQ ID NO: 1247); Arg$^{34}$-GLP-1(7-37) (SEQ ID NO: 1248); Glu$^{30}$-GLP-1(7-37) (SEQ ID NO: 1249); Lys$^{22}$-GLP-1(7-37) (SEQ ID NO: 1250); Gy$^{8,36}$,Glu$^{30}$-GLP-1(7-37) (SEQ ID NO: 1251); Val$^8$,Glu$^{22}$,Gly$^{36}$-GLP-1(7-37) (SEQ ID NO: 1252); Gly$^{8,36}$,Glu$^{22}$,Lys$^{33}$,Asn$^{34}$-GLP-1(7-37) (SEQ ID NO: 1253); Val$^8$,Glu$^{22}$,Lys$^{33}$,Asn$^{34}$,Gly$^{36}$-GLP-1(7-37) (SEQ ID NO: 1254); Gly$^{8,36}$,Glu$^{22}$,Pro$^{37}$-GLP-1(7-37) (SEQ ID NO: 1255); Val$^8$,Glu$^{22}$,Gly$^{36}$Pro$^{37}$-GLP-1(7-37) (SEQ ID NO: 1256); Gly$^{8,36}$,Glu$^{22}$,Lys$^{33}$, Asn$^{34}$,Pro$^{37}$-GLP-1(7-37) (SEQ ID NO: 1257); Val$^8$,Glu$^{22}$,Lys$^{33}$,Asn$^{34}$,Gly$^{36}$,Pro$^{37}$-GLP-1(7-37) (SEQ ID NO: 1258); Gly$^{8,36}$,Glu$^{22}$-GLP-1(7-36) (SEQ ID NO: 1259); Val$^8$,Glu$^{22}$,Gly$^{36}$-GLP-1(7-36) (SEQ ID NO: 1260); Val$^8$,Glu$^{22}$,Asn$^{34}$,Gly$^{36}$-GLP-1(7-36) (SEQ ID NO: 1261); and Gly$^{8,36}$,Glu$^{22}$,Asn$^{34}$-GLP-1(7-36) (SEQ ID NO: 1262).

In another embodiment, the subject is a mammal. In another embodiment, the subject is human. In another embodiment, the GIPR is human GIPR. In another embodiment, the administering is by parenteral injection. In another embodiment, the administering is by subcutaneous injection.

In another aspect the present disclosure provides an antigen binding protein that specifically binds to a human GIPR polypeptide and inhibits activation of GIPR by GIP ligand. In one embodiment, the antigen binding protein inhibits GIP ligand binding to GIPR. In another embodiment, the antigen binding protein is a human antigen binding protein. In another embodiment, the antigen binding protein is a human antibody. In another embodiment, the antigen binding protein is a monoclonal antibody.

In another aspect, the present disclosure provides a pharmaceutical composition comprising at least one antigen binding protein according to any one of the foregoing embodiments.

In another aspect, the present disclosure provides a nucleic acid molecule encoding an antigen binding protein according to any one of the foregoing embodiments.

In another aspect, the present disclosure provides a vector comprising a nucleic acid molecule encoding an antigen binding protein according to any one of the foregoing embodiments.

In another aspect, the present disclosure provides a host cell comprising a nucleic acid molecule encoding an antigen binding protein according to any one of the foregoing embodiments or a vector comprising a nucleic acid molecule encoding an antigen binding protein according to any one of the foregoing embodiments. In another aspect the present disclosure provides an antigen binding protein that specifically binds to a human GIPR polypeptide expressed by the vector.

In another aspect, the present disclosure provides a method of making an antigen binding protein according to any one of the foregoing embodiments, the method comprising expressing the antigen binding protein in a host cell that secretes the antigen binding protein, and then purifying the antigen binding protein from the cell culture media. In another aspect the present disclosure provides an antigen binding protein that specifically binds to a human GIPR polypeptide purified from the host cell.

In another aspect, the present disclosure provides an antigen binding protein of any one of the foregoing embodiments or a pharmaceutical composition of any one of the foregoing embodiments for use in therapy.

DETAILED DESCRIPTION OF THE INVENTION

The present disclosure provides a method of treating a metabolic disorder, such as a disorder of glucose metabolism (e.g. Type 2 diabetes, elevated glucose levels, elevated insulin levels, dyslipidemia, metabolic syndrome (Syndrome X or insulin resistance syndrome), glucosuria, metabolic acidosis, Type 1 diabetes, obesity and conditions exacerbated by obesity) by blocking or interfering with the biological activity of GIP. In one embodiment, a therapeutically effective amount of an isolated human GIPR binding protein is administered to a subject in need thereof. Methods of administration and delivery are also provided.

Recombinant polypeptide and nucleic acid methods used herein, including in the Examples, are generally those set forth in Sambrook et al., Molecular Cloning: A Laboratory Manual (Cold Spring Harbor Laboratory Press, 1989) or Current Protocols in Molecular Biology (Ausubel et al., eds., Green Publishers Inc. and Wiley and Sons 1994), both of which are incorporated herein by reference for any purpose.

The section headings used herein are for organizational purposes only and are not to be construed as limiting the subject matter described.

Unless otherwise defined herein, scientific and technical terms used in connection with the present application shall have the meanings that are commonly understood by those of ordinary skill in the art. Further, unless otherwise required by context, singular terms shall include pluralities and plural terms shall include the singular.

Generally, nomenclatures used in connection with, and techniques of, cell and tissue culture, molecular biology, immunology, microbiology, genetics and protein and nucleic acid chemistry and hybridization described herein are those well-known and commonly used in the art. The methods and techniques of the present application are generally performed according to conventional methods well known in the art and as described in various general and more specific references that are cited and discussed throughout the present specification unless otherwise indicated. See, e.g., Sambrook et al., Molecular Cloning: A Laboratory Manual, 3rd ed., Cold Spring Harbor Laboratory Press, Cold Spring Harbor, N.Y. (2001), Ausubel et al., Current Protocols in Molecular Biology, Greene Publishing Associates (1992), and Harlow and Lane Antibodies: A Laboratory Manual Cold Spring Harbor Laboratory Press, Cold Spring Harbor, N.Y. (1990), which are incorporated herein by reference. Enzymatic reactions and purification techniques are performed according to manufacturer's specifications, as commonly accomplished in the art or as described herein. The terminology used in connection with, and the laboratory procedures and techniques of, analytical chemistry, synthetic organic chemistry, and medicinal and pharmaceutical chemistry described herein are those well-known and commonly used in the art. Standard techniques can be used for chemical syntheses, chemical analyses, pharmaceutical preparation, formulation, and delivery, and treatment of patients.

It should be understood that this invention is not limited to the particular methodology, protocols, and reagents, etc., described herein and as such may vary. The terminology used herein is for the purpose of describing particular embodiments only, and is not intended to limit the scope of the disclosed, which is defined solely by the claims.

Other than in the operating examples, or where otherwise indicated, all numbers expressing quantities of ingredients or reaction conditions used herein should be understood as modified in all instances by the term "about." The term "about" when used in connection with percentages may mean±1%.

Following convention, as used herein "a" and "an" mean "one or more" unless specifically indicated otherwise.

As used herein, the terms "amino acid" and "residue" are interchangeable and, when used in the context of a peptide or polypeptide, refer to both naturally occurring and synthetic amino acids, as well as amino acid analogs, amino acid mimetics and non-naturally occurring amino acids that are chemically similar to the naturally occurring amino acids.

A "naturally occurring amino acid" is an amino acid that is encoded by the genetic code, as well as those amino acids that are encoded by the genetic code that are modified after synthesis, e.g., hydroxyproline, γ-carboxyglutamate, and O-phosphoserine. An amino acid analog is a compound that has the same basic chemical structure as a naturally occurring amino acid, i.e., an α carbon that is bound to a hydrogen, a carboxyl group, an amino group, and an R group, e.g., homoserine, norleucine, methionine sulfoxide, methionine methyl sulfonium. Such analogs can have modified R groups (e.g., norleucine) or modified peptide backbones, but will retain the same basic chemical structure as a naturally occurring amino acid.

An "amino acid mimetic" is a chemical compound that has a structure that is different from the general chemical structure of an amino acid, but that functions in a manner similar to a naturally occurring amino acid. Examples include a methacryloyl or acryloyl derivative of an amide, β-, γ-, δ-amino acids (such as piperidine-4-carboxylic acid) and the like.

A "non-naturally occurring amino acid" is a compound that has the same basic chemical structure as a naturally occurring amino acid, but is not incorporated into a growing polypeptide chain by the translation complex. "Non-naturally occurring amino acid" also includes, but is not limited to, amino acids that occur by modification (e.g., posttranslational modifications) of a naturally encoded amino acid (including but not limited to, the 20 common amino acids) but are not themselves naturally incorporated into a growing polypeptide chain by the translation complex. A non-limiting lists of examples of non-naturally occurring amino acids that can be inserted into a polypeptide sequence or substituted for a wild-type residue in polypeptide sequence include β-amino acids, homoamino acids, cyclic amino acids and amino acids with derivatized side chains. Examples include (in the L-form or D-form; abbreviated as in parentheses); citrulline (Cit), homocitrulline (hCit), Nα-methylcitrulline (NMeCit), Nα-methylhomocitrulline (Nα-MeHoCit), ornithine (Om), Nα-Methylornithine (Nα-MeOrn or NMeOrn), sarcosine (Sar), homolysine (hLys or hK), homoarginine (hArg or hR), homoglutamine (hQ), Nα-methylarginine (NMeR), Nα-methylleucine (Nα-MeL or NMeL), N-methylhomolysine (NMeHoK), Nα-methylglutamine (NMeQ), norleucine (Nle), norvaline (Nva), 1,2,3,4-tetrahydroisoquinoline (Tic), Octahydroindole-2-carboxylic acid (Oic), 3-(1-naphthy)alanine (1-Nal), 3-(2-naphthyl)alanine (2-Nal), 1,2,3,4-tetrahydroisoquinoline (Tic), 2-indanylglycine (IgI), para-iodophenylalanine (pI-Phe), para-aminophenylalanine (4AmP or 4-Amino-Phe), 4-guanidino phenylalanine (Guf), glycyllysine (abbreviated "K(Nε-glycyl)" or "K(glycyl)" or "K(gly)"), nitrophenylalanine (nitrophe), aminophenylalanine (aminophe or Amino-Phe), benzylphenylalanine (benzylphe), γ-carboxyglutamic acid (γ-carboxyglu), hydroxyproline (hydroxypro), p-carboxyl-phenylalanine (Cpa), α-aminoadipic acid (Aad), Nα-methyl valine (NMeVal), N-α-methyl leucine (NMeLeu), Nα-methylnorleucine (NMeNle), cyclopentylglycine (Cpg), cyclohexylglycine (Chg), acetylarginine (acetylarg), α, β-diaminopropionoic acid (Dpr), α, γ-diaminobutyric acid (Dab), diaminopropionic acid (Dap), cyclohexylalanine (Cha), 4-methyl-phenylalanine (MePhe), β, β-diphenyl-alanine (BiPhA), aminobutyric acid (Abu), 4-phenyl-phenylalanine (or biphenylalanine; 4Bip), α-amino-isobutyric acid (Aib), beta-alanine, beta-aminopropionic acid, piperidinic acid, aminocaprioic acid, aminoheptanoic acid, aminopimelic acid, desmosine, diaminopimelic acid, N-ethylglycine, N-ethylaspargine, hydroxylysine, allo-hydroxylysine, isodesmosine, allo-isoleucine, N-methylglycine, N-methylisoleucine, N-methylvaline, 4-hydroxyproline (Hyp), γ-carboxyglutamate, ε-N,N,N-trimethyllysine, ε-N-acetyllysine, O-phosphoserine, N-acetylserine, N-formylmethionine, 3-methylhistidine, 5-hydroxylysine, ω-methylarginine, 4-Amino-O-Phthalic Acid (4APA), and other similar amino acids, and derivatized forms of any of those specifically listed.

The term "isolated nucleic acid molecule" refers to a single or double-stranded polymer of deoxyribonucleotide or ribonucleotide bases read from the 5' to the 3' end (e.g., a GIPR nucleic acid sequence provided herein), or an analog thereof, that has been separated from at least about 50 percent of polypeptides, peptides, lipids, carbohydrates, polynucleotides or other materials with which the nucleic acid is naturally found when total nucleic acid is isolated from the source cells. Preferably, an isolated nucleic acid molecule is substantially free from any other contaminating nucleic acid molecules or other molecules that are found in the natural environment of the nucleic acid that would interfere with its use in polypeptide production or its therapeutic, diagnostic, prophylactic or research use.

The term "isolated polypeptide" refers to a polypeptide (e.g., a GIPR polypeptide sequence provided herein or an antigen binding protein of the present invention) that has been separated from at least about 50 percent of polypeptides, peptides, lipids, carbohydrates, polynucleotides, or other materials with which the polypeptide is naturally found when isolated from a source cell. Preferably, the isolated polypeptide is substantially free from any other contaminating polypeptides or other contaminants that are found in its natural environment that would interfere with its therapeutic, diagnostic, prophylactic or research use.

The term "encoding" refers to a polynucleotide sequence encoding one or more amino acids. The term does not require a start or stop codon.

The terms "identical" and percent "identity," in the context of two or more nucleic acids or polypeptide sequences, refer to two or more sequences or subsequences that are the same. "Percent identity" means the percent of identical residues between the amino acids or nucleotides in the compared molecules and is calculated based on the size of the smallest of the molecules being compared. For these calculations, gaps in alignments (if any) can be addressed by a particular mathematical model or computer program (i.e., an "algorithm"). Methods that can be used to calculate the identity of the aligned nucleic acids or polypeptides include those described in Computational Molecular Biology, (Lesk, A. M., ed.), (1988) New York: Oxford University Press; Biocomputing Informatics and Genome Projects, (Smith, D. W., ed.), 1993, New York: Academic Press; Computer Analysis of Sequence Data, Part I, (Griffin, A. M., and Griffin, H. G., eds.), 1994, New Jersey: Humana Press; von Heinje, G., (1987) Sequence Analysis in Molecular Biology, New York: Academic Press; Sequence Analysis Primer, (Gribskov, M. and Devereux, J., eds.), 1991, New York: M. Stockton Press; and Carillo et al., (1988) SIAM J. Applied Math. 48:1073.

In calculating percent identity, the sequences being compared are aligned in a way that gives the largest match between the sequences. The computer program used to determine percent identity is the GCG program package, which includes GAP (Devereux et al., (1984) Nucl. Acid Res. 12:387; Genetics Computer Group, University of Wisconsin, Madison, WI). The computer algorithm GAP is used to align the two polypeptides or polynucleotides for which the percent sequence identity is to be determined. The sequences are aligned for optimal matching of their respective amino acid or nucleotide (the "matched span", as determined by the algorithm). A gap opening penalty (which is calculated as 3× the average diagonal, wherein the "average diagonal" is the average of the diagonal of the comparison matrix being used; the "diagonal" is the score or number assigned to each perfect amino acid match by the particular comparison matrix) and a gap extension penalty (which is usually 1/10 times the gap opening penalty), as well as a comparison matrix such as PAM 250 or BLOSUM 62 are used in conjunction with the algorithm. In certain embodiments, a standard comparison matrix (see, Dayhoff et al., (1978) Atlas of Protein Sequence and Structure 5:345-352 for the PAM 250 comparison matrix; Henikoff et al., (1992) Proc. Natl. Acad. Sci. U.S.A. 89:10915-10919 for the BLOSUM 62 comparison matrix) is also used by the algorithm.

Recommended parameters for determining percent identity for polypeptides or nucleotide sequences using the GAP program are the following:

Algorithm: Needleman et al., 1970, J. Mol. Biol. 48:443-453;

Comparison matrix: BLOSUM 62 from Henikoff et al., 1992, supra;

Gap Penalty: 12 (but with no penalty for end gaps)

Gap Length Penalty: 4

Threshold of Similarity: 0

Certain alignment schemes for aligning two amino acid sequences can result in matching of only a short region of the two sequences, and this small aligned region can have very high sequence identity even though there is no significant relationship between the two full-length sequences. Accordingly, the selected alignment method (e.g., the GAP program) can be adjusted if so desired to result in an alignment that spans at least 50 contiguous amino acids of the target polypeptide.

The terms "GIPR polypeptide" and "GIPR protein" are used interchangeably and mean a naturally-occurring wild-type polypeptide expressed in a mammal, such as a human or a mouse, and includes naturally occurring alleles (e.g., naturally occurring allelic forms of human GIPR protein). For purposes of this disclosure, the term "GIPR polypeptide" can be used interchangeably to refer to any full-length GIPR polypeptide, e.g., SEQ ID NO: 1201, which consists of 466 amino acid residues and which is encoded by the nucleotide sequence SEQ ID NO: 1202, or SEQ ID NO: 1203, which consists of 430 amino acid residues and which is encoded by the nucleic acid sequence SEQ ID NO: 1204, or SEQ ID NO: 1205, which consists of 493 amino acid resides and which is encoded by the nucleic acid sequence of SEQ ID NO: 1206, or SEQ ID NO: 1207, which consists of 460 amino acids residues and which is encoded by the nucleic acid sequence of SEQ ID NO: 1208, or SEQ ID NO: 1209, which consists of 230 amino acids residues and which is encoded by the nucleic acid sequence of SEQ ID NO: 1210.

The term "GIPR polypeptide" also encompasses a GIPR polypeptide in which a naturally occurring GIPR polypeptide sequence (e.g., SEQ ID NOs: 1201, 1203 or 1205) has been modified. Such modifications include, but are not limited to, one or more amino acid substitutions, including substitutions with non-naturally occurring amino acids non-naturally-occurring amino acid analogs and amino acid mimetics.

In various embodiments, a GIPR polypeptide comprises an amino acid sequence that is at least about 85 percent identical to a naturally-occurring GIPR polypeptide (e.g., SEQ ID NOs: 1201, 1203 or 1205). In other embodiments, a GIPR polypeptide comprises an amino acid sequence that is at least about 90 percent, or about 95, 96, 97, 98, or 99 percent identical to a naturally-occurring GIPR polypeptide amino acid sequence (e.g., SEQ ID NOs: 1201, 1203 or 1205). Such GIPR polypeptides preferably, but need not, possess at least one activity of a wild-type GIPR polypeptide, such as the ability to bind GIP. The present invention also encompasses nucleic acid molecules encoding such GIPR polypeptide sequences.

The terms "GIPR activity assay" (also referred to as a "GIPR functional assay") means an assay that can be used to measure GIP or a GIP binding protein activity in a cellular setting. In one embodiment, the "activity" (or "functional") assay" can be a cAMP assay in GIPR expressing cells, in which GIP can induce cAMP signal, and the activity of a GIP/GIPR binding protein could be measured in the presence/absence of GIP ligand, in which IC50/EC50 and degree of inhibition/activation can be obtained (Biochemical and Biophysical Research Communications (2002) 290:1420-1426). In another embodiment, the "activity" (or "functional") assay can be an insulin secretion assay in pancreatic beta cells, in which GIP can induce glucose-dependent insulin secretion, and the activity of a GIP/GIPR binding protein could be measured in the presence/absence of GIP ligand, in which IC50/EC50 and degree of inhibition/activation can be obtained (Biochemical and Biophysical Research Communications (2002) 290:1420-1426).

The term "GIPR binding assay" means an assay that can be used to measure binding of GIP to GIPR. In one embodiment, "GIPR binding assay" can be an assay using FMAT or FACS that measures fluorescence-labeled GIP binding to GIPR expression cells, and GIP/GIPR binding protein's activity can be measured for displacing fluorescence-labeled GIP binding to GIPR expression cells. In another embodiment, "GIPR binding assay" can be an assay that measures radioactive-labeled GIP binding to GIPR expression cells, and GIP/GIPR binding protein's activity can be measured for displacing radioactive labeled GIP binding to GIPR expression cells (Biochimica et Biophysica Acta (2001) 1547:143-155).

The terms "GIP", "Gastric inhibitory polypeptide", "glucose-dependent insulinotropic peptide" and "GIP ligand" are used interchangeably and mean a naturally-occurring wild-type polypeptide expressed in a mammal, such as a human or a mouse, and includes naturally occurring alleles (e.g., naturally occurring allelic forms of human GIP protein). For purposes of this disclosure, the term "GIP" can be used interchangeably to refer to any mature GIP polypeptide.

The 42 amino acid sequence of mature human GIP is:

YAEGTFISDY SIAMDKIHQQ DFVNWLLAQK GKKNDWKHNI TQ (SEQ ID NO: 1211)

and is encoded by the DNA sequence:

tatgcggaag gcacctttat tagcgattat agcattgcga tggataaaat tcatcagcag gattttgtga actggctgct ggcgcagaaa ggcaaaaaaa acgattggaa acataacatt acccag (SEQ ID NO: 1212).

The 42 amino acid sequence of mature murine GIP is:

YAEGTFISDY SIAMDKIRQQ DFVNWLLAQR GKKSDWKHNI TQ (SEQ ID NO: 1213)

and is encoded by the DNA sequence:

tatgcggaag gcacctttat tagcgattat agcattgcga tggataaaat tcgccagcag gattttgtga actggctgct ggcgcagcgc ggcaaaaaaa gcgattggaa acataacatt acccag (SEQ ID NO: 1214).

The 42 amino acid sequence of mature rat GIP is:

YAEGTFISDY SIAMDKIRQQ DFVNWLLAQK GKKNDWKHNL TQ (SEQ ID NO: 1215)

and is encoded by the DNA sequence:

tatgcggaag gcacctttat tagcgattat agcattgcga tggataaaat tcgccagcag gattttgtga actggctgctg gcgcagaaag gcaaaaaaaa cgattggaaa cataacctga cccag (SEQ ID NO: 1216).

An "antigen binding protein" as used herein means any protein that specifically binds a specified target antigen, such as a GIPR polypeptide (e.g., a human GIPR polypeptide such as provided in SEQ ID NOs: 1201, 1203 or 1205). The term encompasses intact antibodies that comprise at least two full-length heavy chains and two full-length light chains, as well as derivatives, variants, fragments, and mutations thereof. Examples of antibody fragments include Fab, Fab', F(ab')2, and Fv fragments. An antigen binding protein also includes domain antibodies such as nanobodies and scFvs as described further below.

In general, a GIPR antigen binding protein is said to "specifically bind" its target antigen GIPR when the antigen binding protein exhibits essentially background binding to non-GIPR molecules. An antigen binding protein that specifically binds GIPR may, however, cross-react with GIPR polypeptides from different species. Typically, a GIPR antigen binding protein specifically binds human GIPR when the dissociation constant (KD) is $\leq 10^{-7}$ M as measured via a surface plasma resonance technique (e.g., BIACore, GE-Healthcare Uppsala, Sweden) or Kinetic Exclusion Assay (KinExA, Sapidyne, Boise, Idaho). A GIPR antigen binding protein specifically binds human GIPR with "high affinity" when the KD is $\leq 5\times 10^{-9}$ M, and with "very high affinity" when the KD is $\leq 5\times 10^{-10}$ M, as measured using methods described.

"Antigen binding region" means a protein, or a portion of a protein, that specifically binds a specified antigen. For example, that portion of an antigen binding protein that contains the amino acid residues that interact with an antigen and confer on the antigen binding protein its specificity and affinity for the antigen is referred to as "antigen binding region." An antigen binding region typically includes one or more "complementary binding regions" ("CDRs") of an immunoglobulin, single-chain immunoglobulin, or camelid antibody. Certain antigen binding regions also include one or more "framework" regions. A "CDR" is an amino acid sequence that contributes to antigen binding specificity and affinity. "Framework" regions can aid in maintaining the proper conformation of the CDRs to promote binding between the antigen binding region and an antigen.

A "recombinant protein", including a recombinant GIPR antigen binding protein, is a protein made using recombinant techniques, i.e., through the expression of a recombinant nucleic acid as described herein. Methods and techniques for the production of recombinant proteins are well known in the art.

The term "antibody" refers to an intact immunoglobulin of any isotype, or a fragment thereof that can compete with the intact antibody for specific binding to the target antigen, and includes, for instance, chimeric, humanized, fully human, and bispecific antibodies. An "antibody" as such is a species of an antigen binding protein. An intact antibody generally will comprise at least two full-length heavy chains and two full-length light chains. Antibodies may be derived solely from a single source, or may be "chimeric," that is, different portions of the antibody may be derived from two different antibodies as described further below. The antigen binding proteins, antibodies, or binding fragments may be produced in hybridomas, by recombinant DNA techniques, or by enzymatic or chemical cleavage of intact antibodies.

The term "light chain" as used with respect to an antibody or fragments thereof includes a full-length light chain and fragments thereof having sufficient variable region sequence to confer binding specificity. A full-length light chain includes a variable region domain, VL, and a constant region domain, CL. The variable region domain of the light chain is at the amino-terminus of the polypeptide. Light chains include kappa chains and lambda chains.

The term "heavy chain" as used with respect to an antibody or fragment thereof includes a full-length heavy chain and fragments thereof having sufficient variable region sequence to confer binding specificity. A full-length heavy chain includes a variable region domain, VH, and three constant region domains, CH1, CH2, and CH3. The VH domain is at the amino-terminus of the polypeptide, and the CH domains are at the carboxyl-terminus, with the CH3 being closest to the carboxy-terminus of the polypeptide. Heavy chains may be of any isotype, including IgG (including IgG1, IgG2, IgG3 and IgG4 subtypes), IgA (including IgA1 and IgA2 subtypes), IgM and IgE.

The term "immunologically functional fragment" (or simply "fragment") of an antibody or immunoglobulin chain (heavy or light chain), as used herein, is an antigen binding protein comprising a portion (regardless of how that portion is obtained or synthesized) of an antibody that lacks at least some of the amino acids present in a full-length chain but which is capable of specifically binding to an antigen. Such fragments are biologically active in that they bind specifically to the target antigen and can compete with other antigen binding proteins, including intact antibodies, for specific binding to a given epitope.

These biologically active fragments may be produced by recombinant DNA techniques, or may be produced by enzymatic or chemical cleavage of antigen binding proteins, including intact antibodies. Immunologically functional immunoglobulin fragments include, but are not limited to, Fab, Fab', and $F(ab')_2$ fragments.

In another embodiment, Fvs, domain antibodies and scFvs, and may be derived from an antibody of the present invention.

It is contemplated further that a functional portion of the antigen binding proteins disclosed herein, for example, one or more CDRs, could be covalently bound to a second protein or to a small molecule to create a therapeutic agent directed to a particular target in the body, possessing bifunctional therapeutic properties, or having a prolonged serum half-life.

A "Fab fragment" is comprised of one light chain and the CH1 and variable regions of one heavy chain. The heavy chain of a Fab molecule cannot form a disulfide bond with another heavy chain molecule.

An "Fc" region contains two heavy chain fragments comprising the CH2 and CH3 domains of an antibody. The two heavy chain fragments are held together by two or more disulfide bonds and by hydrophobic interactions of the CH3 domains.

In certain embodiments, one or more amino acid modifications may be introduced into the Fc region of an antibody provided herein, thereby generating an Fc region variant. The Fc region variant may comprise a human Fc region sequence (e.g., a human IgG1, IgG2, IgG3 or IgG4 Fc region) comprising an amino acid modification (e.g. a substitution) at one or more amino acid positions.

In certain embodiments, the invention contemplates an antibody variant that possesses some but not all effector functions, which make it a desirable candidate for applications in which the half life of the antibody in vivo is important yet certain effector functions (such as complement and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the antibody lacks Fc.gamma.R binding (hence likely lacking ADCC activity), but retains FcRn binding ability. The primary cells for mediating ADCC, NK cells, express Fc(RIII only, whereas monocytes express Fc(RI, Fc(RII and Fc(RIII. FcR expression on hematopoietic cells is summarized in Table 3 on page 464 of Ravetch and Kinet, Annu. Rev. Immunol. 9:457-492 (1991). Non-limiting examples of in vitro assays to assess ADCC activity of a molecule of interest is described in U.S. Pat. No. 5,500,362 (see, e.g. Hellstrom, I. et al. Proc. Nat'l Acad. Sci. USA 83:7059-7063 (1986)) and Hellstrom, I et al., Proc. Nat'l Acad. Sci. USA 82:1499-1502 (1985); 5,821,337 (see Bruggemann, M. et al., J. Exp. Med. 166:1351-1361 (1987)). Alternatively, non-radioactive assays methods may be employed (see, for example, ACTI™ non-radioactive cytotoxicity assay for flow cytometry (CellTechnology, Inc. Mountain View, Calif; and CytoTox 96® non-radioactive cytotoxicity assay (Promega, Madison, Wis.). Useful effector cells for such assays include peripheral blood mononuclear cells (PBMC) and Natural Killer (NK) cells. Alternatively, or additionally, ADCC activity of the molecule of interest may be assessed in vivo, e.g., in a animal model such as that disclosed in Clynes et al. Proc. Nat'l Acad. Sci. USA 95:652-656 (1998). C1q binding assays may also be carried out to confirm that the antibody is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., J. Immunol. Methods 202:163 (1996); Cragg, M. S. et al., Blood 101:1045-1052 (2003); and Cragg, M. S. and M. J. Glennie, Blood 103:2738-2743 (2004)). FcRn binding and in vivo clearance/half life determinations can also be performed using methods known in the art (see, e.g., Petkova, S. B. et al., Int'l. Immunol. 18(12):1759-1769 (2006)).

In some embodiments, one or more amino acid modifications may be introduced into the Fc portion of the antibody provided herein in order to increase IgG binding to the neonatal Fc receptor. In certain embodiments, the antibody comprises the following three mutations according to EU numbering: M252Y, S254T, and T256E (the "YTE mutation") (U.S. Pat. No. 8,697,650; see also Dall'Acqua et al., Journal of Biological Chemistry 281(33):23514-23524 (2006). In certain embodiments, the YTE mutation does not affect the ability of the antibody to bind to its cognate antigen. In certain embodiments, the YTE mutation increases the antibody's serum half-life compared to the native (i.e., non-YTE mutant) antibody. In some embodiments, the YTE mutation increases the serum half-life of the antibody by 3-fold compared to the native (i.e., non-YTE mutant) antibody. In some embodiments, the YTE mutation increases the serum half-life of the antibody by 2-fold compared to the native (i.e., non-YTE mutant) antibody. In some embodiments, the YTE mutation increases the serum half-life of the antibody by 4-fold compared to the native (i.e., non-YTE mutant) antibody. In some embodiments, the YTE mutation increases the serum half-life of the antibody by at least 5-fold compared to the native (i.e., non-YTE mutant) antibody. In some embodiments, the YTE mutation increases the serum half-life of the antibody by at least 10-fold compared to the native (i.e., non-YTE mutant) antibody. See, e.g., U.S. Pat. No. 8,697,650; see also Dall'Acqua et al., Journal of Biological Chemistry 281(33): 23514-23524 (2006).

In certain embodiments, the YTE mutant provides a means to modulate antibody-dependent cell-mediated cytotoxicity (ADCC) activity of the antibody. In certain embodiments, the YTEO mutant provides a means to modulate ADCC activity of a humanized IgG antibody directed against a human antigen. See, e.g., U.S. Pat. No. 8,697,650; see also Dall'Acqua et al., Journal of Biological Chemistry 281(33):23514-23524 (2006). In certain embodiments, the YTE mutant allows the simultaneous modulation of serum half-life, tissue distribution, and antibody activity (e.g., the ADCC activity of an IgG antibody). See, e.g., U.S. Pat. No. 8,697,650; see also Dall'Acqua et al., Journal of Biological Chemistry 281(33):23514-23524 (2006).

Antibodies with reduced effector function include those with substitution of one or more of Fc region residues 238, 265, 269, 270, 297, 327 and 329 according to EU numbering (U.S. Pat. No. 6,737,056). Such Fc mutants include Fc mutants with substitutions at two or more of amino acid positions 265, 269, 270, 297 and 327 according to EU numbering, including the so-called "DANA" Fc mutant with substitution of residues 265 and 297 to alanine according to EU numbering (i.e., D265A and N297A according to EU numbering) (U.S. Pat. No. 7,332,581). In certain embodiments the Fc mutant comprises the following two amino acid substitutions: D265A and N297A. In certain embodiments the Fc mutant consists of the following two amino acid substitutions: D265A and N297A.

In certain embodiments, the proline at position 329 (EU numbering) (P329) of a wild-type human Fc region is substituted with glycine or arginine or an amino acid residue large enough to destroy the proline sandwich within the Fc/Fc.gamma. receptor interface, that is formed between the P329 of the Fc and tryptophane residues W87 and W110 of FcgRIII (Sondermann et al.: Nature 406, 267-273 (20 Jul. 2000)). In a further embodiment, at least one further amino acid substitution in the Fc variant is S228P, E233P, L234A, L235A, L235E, N297A, N297D, or P331S and still in another embodiment said at least one further amino acid substitution is L234A and L235A of the human IgG1 Fc region or S228P and L235E of the human IgG4 Fc region, all according to EU numbering (U.S. Pat. No. 8,969,526 which is incorporated by reference in its entirety).

In certain embodiments, a polypeptide comprises the Fc variant of a wild-type human IgG Fc region wherein the polypeptide has P329 of the human IgG Fc region substituted with glycine and wherein the Fc variant comprises at least two further amino acid substitutions at L234A and L235A of the human IgG1 Fc region or S228P and L235E of the human IgG4 Fc region, and wherein the residues are numbered according to the EU numbering (U.S. Pat. No. 8,969,526 which is incorporated by reference in its entirety). In certain embodiments, the polypeptide comprising the P329G, L234A and L235A (EU numbering) substitutions exhibit a reduced affinity to the human Fc.gamma.RIIIA and Fc.gamma.RIIA, for down-modulation of ADCC to at least 20% of the ADCC induced by the polypeptide comprising the wildtype human IgG Fc region, and/or for down-modulation of ADCP (U.S. Pat. No. 8,969,526 which is incorporated by reference in its entirety).

In a specific embodiment the polypeptide comprising an Fc variant of a wildtype human Fc polypeptide comprises a triple mutation: an amino acid substitution at position Pro329, a L234A and a L235A mutation according to EU numbering (P329/LALA) (U.S. Pat. No. 8,969,526 which is incorporated by reference in its entirety). In specific embodiments, the polypeptide comprises the following amino acid substitutions: P329G, L234A, and L235A according to EU numbering.

Certain antibody variants with improved or diminished binding to FcRs are described. (See, e.g., U.S. Pat. No. 6,737,056; WO 2004/056312, and Shields et al., J. Biol. Chem. 9(2): 6591-6604 (2001).)

In certain embodiments, an antibody variant comprises an Fc region with one or more amino acid substitutions which improve ADCC, e.g., substitutions at positions 298, 333, and/or 334 of the Fc region (EU numbering).

In some embodiments, alterations are made in the Fc region that result in altered (i. e., either improved or diminished) C1q binding and/or Complement Dependent Cytotoxicity (CDC), e.g., as described in U.S. Pat. No. 6,194,551, WO 99/51642, and Idusogie et al. J Immunol. 164: 4178-4184 (2000).

Antibodies with increased half lives and improved binding to the neonatal Fc receptor (FcRn), which is responsible for the transfer of maternal IgGs to the fetus (Guyer et al., J. Immunol. 117:587 (1976) and Kim et al., J. Immunol. 24:249 (1994)), are described in US2005/0014934A1 (Hinton et al.).

Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434, e.g., substitution of Fc region residue 434 (U.S. Pat. No. 7,371,826) according to EU numbering. See also Duncan & Winter, Nature 322:738-40 (1988); U.S. Pat. Nos. 5,648,260; 5,624,821; and WO 94/29351 concerning other examples of Fc region variants.

An "Fab' fragment" contains one light chain and a portion of one heavy chain that contains the VH domain and the CH1 domain and also the region between the CH1 and CH2 domains, such that an interchain disulfide bond can be formed between the two heavy chains of two Fab' fragments to form an F(ab')2 molecule.

An "F(ab')2 fragment" contains two light chains and two heavy chains containing a portion of the constant region between the CH1 and CH2 domains, such that an interchain disulfide bond is formed between the two heavy chains. A F(ab')2 fragment thus is composed of two Fab' fragments that are held together by a disulfide bond between the two heavy chains.

The "Fv region" comprises the variable regions from both the heavy and light chains, but lacks the constant regions.

"Single chain antibodies" or "scFvs" are Fv molecules in which the heavy and light chain variable regions have been connected by a flexible linker to form a single polypeptide chain, which forms an antigen-binding region. scFvs are discussed in detail in International Patent Application Publication No. WO 88/01649 and U.S. Pat. Nos. 4,946,778 and 5,260,203, the disclosures of which are incorporated by reference.

A "domain antibody" or "single chain immunoglobulin" is an immunologically functional immunoglobulin fragment containing only the variable region of a heavy chain or the variable region of a light chain. Examples of domain antibodies include Nanobodies®. In some instances, two or more VH regions are covalently joined with a peptide linker to create a bivalent domain antibody. The two VH regions of a bivalent domain antibody may target the same or different antigens.

A "bivalent antigen binding protein" or "bivalent antibody" comprises two antigen binding regions. In some instances, the two binding regions have the same antigen specificities. Bivalent antigen binding proteins and bivalent antibodies may be bispecific, see, infra.

A multispecific antigen binding protein" or "multispecific antibody" is one that targets more than one antigen or epitope.

A "bispecific," "dual-specific" or "bifunctional" antigen binding protein or antibody is a hybrid antigen binding protein or antibody, respectively, having two different antigen binding sites. Bispecific antigen binding proteins and antibodies are a species of multispecific antigen binding protein or multispecific antibody and may be produced by a variety of methods including, but not limited to, fusion of hybridomas or linking of Fab' fragments. See, e.g., Songsivilai and Lachmann, 1990, Clin. Exp. Immunol. 79:315-321; Kostelny et al., 1992, J. Immunol. 148:1547-1553. The two binding sites of a bispecific antigen binding protein or antibody will bind to two different epitopes, which may reside on the same or different protein targets.

The term "compete" when used in the context of antigen binding proteins (e.g., antibodies) means competition between antigen binding proteins is determined by an assay in which the antigen binding protein (e.g., antibody or immunologically functional fragment thereof) under test prevents or inhibits specific binding of a reference antigen binding protein to a common antigen (e.g., GIPR or a fragment thereof). Numerous types of competitive binding assays can be used, for example: solid phase direct or indirect radioimmunoassay (RIA), solid phase direct or indirect enzyme immunoassay (EIA), sandwich competition assay (see, e.g., Stahli et al., 1983, Methods in Enzymology 9:242-253); solid phase direct biotin-avidin EIA (see, e.g., Kirkland et al., 1986, J. Immunol. 137:3614-3619) solid phase direct labeled assay, solid phase direct labeled sandwich assay (see, e.g., Harlow and Lane, 1988, Antibodies, A Laboratory Manual, Cold Spring Harbor Press); solid phase direct label RIA using 1-125 label (see, e.g., Morel et al., 1988, Molec. Immunol. 25:7-15); solid phase direct biotin-avidin EIA (see, e.g., Cheung, et al., 1990, Virology 176: 546-552); and direct labeled RIA (Moldenhauer et al., 1990, Scand. J. Immunol. 32:77-82). Typically, such an assay involves the use of purified antigen bound to a solid surface or cells bearing either of these, an unlabeled test antigen binding protein and a labeled reference antigen binding protein. Competitive inhibition is measured by determining the amount of label bound to the solid surface or cells in the presence of the test antigen binding protein. Usually the test antigen binding protein is present in excess. Additional details regarding methods for determining competitive binding are provided in the examples herein. Usually, when a competing antigen binding protein is present in excess, it will inhibit specific binding of a reference antigen binding protein to a common antigen by at least 40%, 45%, 50%, 55%, 60%, 65%, 70% or 75%. In some instances, binding is inhibited by at least 80%, 85%, 90%, 95%, or 97% or more.

The term "antigen" refers to a molecule or a portion of a molecule capable of being bound by a selective binding agent, such as an antigen binding protein (including, e.g., an antibody), and additionally capable of being used in an animal to produce antibodies capable of binding to that antigen. An antigen may possess one or more epitopes that are capable of interacting with different antigen binding proteins, e.g., antibodies.

The term "epitope" is the portion of a molecule that is bound by an antigen binding protein (for example, an antibody). The term includes any determinant capable of specifically binding to an antigen binding protein, such as an antibody. An epitope can be contiguous or non-contiguous (discontinuous) (e.g., in a polypeptide, amino acid residues that are not contiguous to one another in the polypeptide sequence but that within in context of the molecule are bound by the antigen binding protein). A conformational epitope is an epitope that exists within the conformation of an active protein but is not present in a denatured protein. In certain embodiments, epitopes may be mimetic in that they comprise a three dimensional structure that is similar to an epitope used to generate the antigen binding protein, yet comprise none or only some of the amino acid residues found in that epitope used to generate the antigen binding protein. Most often, epitopes reside on proteins, but in some instances may reside on other kinds of molecules, such as nucleic acids. Epitope determinants may include chemically active surface groupings of molecules such as amino acids, sugar side chains, phosphoryl or sulfonyl groups, and may have specific three dimensional structural characteristics, and/or specific charge characteristics. Generally, antigen binding proteins specific for a particular target antigen will preferentially recognize an epitope on the target antigen in a complex mixture of proteins and/or macromolecules.

As used herein, "substantially pure" means that the described species of molecule is the predominant species present, that is, on a molar basis it is more abundant than any other individual species in the same mixture. In certain embodiments, a substantially pure molecule is a composition wherein the object species comprises at least 50% (on a molar basis) of all macromolecular species present. In other embodiments, a substantially pure composition will comprise at least 80%, 85%, 90%, 95%, 96%, 97%, 98%, or 99% of all macromolecular species present in the composition. In other embodiments, the object species is purified to essential homogeneity wherein contaminating species cannot be detected in the composition by conventional detection methods and thus the composition consists of a single detectable macromolecular species.

The term "treating" refers to any indicia of success in the treatment or amelioration of an injury, pathology or condition, including any objective or subjective parameter such as abatement; remission; diminishing of symptoms or making the injury, pathology or condition more tolerable to the patient; slowing in the rate of degeneration or decline; making the final point of degeneration less debilitating; improving a patient's physical or mental well-being. The treatment or amelioration of symptoms can be based on objective or subjective parameters; including the results of a physical examination, neuropsychiatric exams, and/or a psychiatric evaluation. For example, certain methods presented herein successfully treat cardiovascular disease such as atherosclerosis by decreasing the incidence of cardiovascular disease, causing remission of cardiovascular disease and/or ameliorating a symptom associated with cardiovascular disease.

An "effective amount" is generally an amount sufficient to reduce the severity and/or frequency of symptoms, eliminate the symptoms and/or underlying cause, prevent the occurrence of symptoms and/or their underlying cause, and/or improve or remediate the damage that results from or is associated with the disease state (e.g., diabetes, obesity, dyslipidemia, elevated glucose levels, elevated insulin levels or diabetic nephropathy. In some embodiments, the effective amount is a therapeutically effective amount or a prophylactically effective amount. A "therapeutically effective amount" is an amount sufficient to remedy a disease state (e.g. atherosclerosis) or symptoms, particularly a state or symptoms associated with the disease state, or otherwise prevent, hinder, retard or reverse the progression of the disease state or any other undesirable symptom associated with the disease in any way whatsoever. A "prophylactically effective amount" is an amount of a pharmaceutical composition that, when administered to a subject, will have the intended prophylactic effect, e.g., preventing or delaying the onset (or reoccurrence) of the disease state, or reducing the likelihood of the onset (or reoccurrence) of the disease state or associated symptoms. The full therapeutic or prophylactic effect does not necessarily occur by administration of one dose, and may occur only after administration of a series of doses. Thus, a therapeutically or prophylactically effective amount may be administered in one or more administrations.

The terms "therapeutically effective dose" and "therapeutically effective amount," as used herein, means an amount of a GIPR binding protein that elicits a biological or medicinal response in a tissue system, animal, or human being sought by a researcher, physician, or other clinician, which includes alleviation or amelioration of the symptoms of the disease or disorder being treated, i.e., an amount of a GIPR binding protein that supports an observable level of one or more desired biological or medicinal response, for example lowering blood glucose, insulin, triglyceride, or cholesterol levels; reducing body weight; or improving glucose tolerance, energy expenditure, or insulin sensitivity.

The term "polynucleotide" or "nucleic acid" includes both single-stranded and double-stranded nucleotide polymers. The nucleotides comprising the polynucleotide can be ribonucleotides or deoxyribonucleotides or a modified form of either type of nucleotide. The modifications include base modifications such as bromouridine and inosine derivatives, ribose modifications such as 2',3'-dideoxyribose, and internucleotide linkage modifications such as phosphorothioate, phosphorodithioate, phosphoroselenoate, phosphorodiselenoate, phosphoroanilothioate, phoshoraniladate and phosphoroamidate.

The term "oligonucleotide" means a polynucleotide comprising 200 or fewer nucleotides. In some embodiments, oligonucleotides are 10 to 60 bases in length. In other embodiments, oligonucleotides are 12, 13, 14, 15, 16, 17, 18, 19, or 20 to 40 nucleotides in length. Oligonucleotides may be single stranded or double stranded, e.g., for use in the construction of a mutant gene. Oligonucleotides may be sense or antisense oligonucleotides. An oligonucleotide can include a label, including a radiolabel, a fluorescent label, a hapten or an antigenic label, for detection assays. Oligonucleotides may be used, for example, as PCR primers, cloning primers or hybridization probes.

An "isolated nucleic acid molecule" means a DNA or RNA of genomic, mRNA, cDNA, or synthetic origin or some combination thereof which is not associated with all or a portion of a polynucleotide in which the isolated polynucleotide is found in nature, or is linked to a polynucleotide to which it is not linked in nature. For purposes of this disclosure, it should be understood that "a nucleic acid molecule comprising" a particular nucleotide sequence does not encompass intact chromosomes. Isolated nucleic acid molecules "comprising" specified nucleic acid sequences may include, in addition to the specified sequences, coding sequences for up to ten or even up to twenty other proteins or portions thereof, or may include operably linked regulatory sequences that control expression of the coding region of the recited nucleic acid sequences, and/or may include vector sequences.

Unless specified otherwise, the left-hand end of any single-stranded polynucleotide sequence discussed herein is the 5' end; the left-hand direction of double-stranded polynucleotide sequences is referred to as the 5' direction. The direction of 5' to 3' addition of nascent RNA transcripts is referred to as the transcription direction; sequence regions on the DNA strand having the same sequence as the RNA transcript that are 5' to the 5' end of the RNA transcript are referred to as "upstream sequences;" sequence regions on the DNA strand having the same sequence as the RNA transcript that are 3' to the 3' end of the RNA transcript are referred to as "downstream sequences."

The term "control sequence" refers to a polynucleotide sequence that can affect the expression and processing of coding sequences to which it is ligated. The nature of such control sequences may depend upon the host organism. In particular embodiments, control sequences for prokaryotes may include a promoter, a ribosomal binding site, and a transcription termination sequence. For example, control sequences for eukaryotes may include promoters comprising one or a plurality of recognition sites for transcription factors, transcription enhancer sequences, and transcription termination sequences. "Control sequences" can include leader sequences and/or fusion partner sequences.

The term "vector" means any molecule or entity (e.g., nucleic acid, plasmid, bacteriophage or virus) used to transfer protein coding information into a host cell.

The term "expression vector" or "expression construct" refers to a vector that is suitable for transformation of a host cell and contains nucleic acid sequences that direct and/or control (in conjunction with the host cell) expression of one or more heterologous coding regions operatively linked thereto. An expression construct may include, but is not limited to, sequences that affect or control transcription, translation, and, if introns are present, affect RNA splicing of a coding region operably linked thereto.

As used herein, "operably linked" means that the components to which the term is applied are in a relationship that allows them to carry out their inherent functions under suitable conditions. For example, a control sequence in a vector that is "operably linked" to a protein coding sequence is ligated thereto so that expression of the protein coding sequence is achieved under conditions compatible with the transcriptional activity of the control sequences.

The term "host cell" means a cell that has been transformed with a nucleic acid sequence and thereby expresses a gene of interest. The term includes the progeny of the parent cell, whether or not the progeny is identical in morphology or in genetic make-up to the original parent cell, so long as the gene of interest is present.

The terms "polypeptide" or "protein" are used interchangeably herein to refer to a polymer of amino acid residues. The terms also apply to amino acid polymers in which one or more amino acid residues is an analog or mimetic of a corresponding naturally occurring amino acid, as well as to naturally occurring amino acid polymers. The terms can also encompass amino acid polymers that have been modified, e.g., by the addition of carbohydrate residues to form glycoproteins, or phosphorylated. Polypeptides and proteins can be produced by a naturally-occurring and non-recombinant cell; or it is produced by a genetically-engineered or recombinant cell, and comprise molecules having the amino acid sequence of the native protein, or molecules having deletions from, additions to, and/or substitutions of one or more amino acids of the native sequence. The terms "polypeptide" and "protein" specifically encompass GIPR antigen binding proteins, antibodies, or sequences that have deletions from, additions to, and/or substitutions of one or more amino acids of an antigen-binding protein. The term "polypeptide fragment" refers to a polypeptide that has an amino-terminal deletion, a carboxyl-terminal deletion, and/or an internal deletion as compared with the full-length protein. Such fragments may also contain modified amino acids as compared with the full-length protein. In certain embodiments, fragments are about five to 500 amino acids long. For example, fragments may be at least 5, 6, 8, 10, 14, 20, 50, 70, 100, 110, 150, 200, 250, 300, 350, 400, or 450 amino acids long. Useful polypeptide fragments include immunologically functional fragments of antibodies, including binding domains.

The term "isolated protein" means that a subject protein (1) is free of at least some other proteins with which it would normally be found, (2) is essentially free of other proteins from the same source, e.g., from the same species, (3) is expressed by a cell from a different species, (4) has been separated from at least about 50 percent of polynucleotides, lipids, carbohydrates, or other materials with which it is associated in nature, (5) is operably associated (by covalent or noncovalent interaction) with a polypeptide with which it is not associated in nature, or (6) does not occur in nature. Typically, an "isolated protein" constitutes at least about 5%, at least about 10%, at least about 25%, or at least about 50% of a given sample. Genomic DNA, cDNA, mRNA or other RNA, of synthetic origin, or any combination thereof may encode such an isolated protein. Preferably, the isolated protein is substantially free from proteins or polypeptides or other contaminants that are found in its natural environment that would interfere with its therapeutic, diagnostic, prophylactic, research or other use.

A "variant" of a polypeptide (e.g., an antigen binding protein such as an antibody) comprises an amino acid sequence wherein one or more amino acid residues are inserted into, deleted from and/or substituted into the amino acid sequence relative to another polypeptide sequence. Variants include fusion proteins.

A "derivative" of a polypeptide is a polypeptide (e.g., an antigen binding protein such as an antibody) that has been chemically modified in some manner distinct from insertion, deletion, or substitution variants, e.g., via conjugation to another chemical moiety.

The term "naturally occurring" as used throughout the specification in connection with biological materials such as polypeptides, nucleic acids, host cells, and the like, refers to materials which are found in nature.

A "subject" or "patient" as used herein can be any mammal. In a typical embodiment, the subject or patient is a human.

As disclosed herein, a GIPR polypeptide described by the instant disclosure can be engineered and/or produced using standard molecular biology methodology. In various examples, a nucleic acid sequence encoding a GIPR, which can comprise all or a portion of SEQ ID NOs: 1203, 1203 or 1205, can be isolated and/or amplified from genomic DNA, or cDNA using appropriate oligonucleotide primers. Primers can be designed based on the nucleic and amino acid sequences provided herein according to standard (RT)-PCR amplification techniques. The amplified GIPR nucleic acid can then be cloned into a suitable vector and characterized by DNA sequence analysis.

Oligonucleotides for use as probes in isolating or amplifying all or a portion of the GIPR sequences provided herein can be designed and generated using standard synthetic techniques, e.g., automated DNA synthesis apparatus, or can be isolated from a longer sequence of DNA.

The 466 amino acid sequence of human GIPR is (Volz et al., FEBS Lett. 373:23-29 (1995); NCBI Reference Sequence: NP_0001555):

```
                                       (SEQ ID NO: 1201)
MTTSPILQLL LRLSLCGLLL QRAETGSKGQ TAGELYQRWE
RYRRECQETL AAAEPPSGLA CNGSFDMYVC WDYAAPNATA
RASCPWYLPW HHHVAAGFVL RQCGSDGQWG LWRDHTQCEN
PEKNEAFLDQ RLILERLQVM YTVGYSLSLA TLLLALLILS
LFRRLHCTRN YIHINLFTSF MLRAAAILSR DRLLPRPGPY
LGDQALALWN QALAACRTAQ IVTQYCVGAN YTWLLVEGVY
LHSLLVLVGG SEEGHFRYYL LLGWGAPALF VIPWVIVRYL
YENTQCWERN EVKAIWWIIR TPILMTILIN FLIFIRILGI
LLSKLRTRQM RCRDYRLRLA RSTLTLVPLL GVHEVVFAPV
TEEQARGALR FAKLGFEIFL SSFQGFLVSV LYCFINKEVQ
SEIRRGWHHC RLRRSLGEEQ RQLPERAFRA LPSGSGPGEV
PTSRGLSSGT LPGPGNEASR ELESYC
```

and is encoded by the DNA sequence (NCBI Reference Sequence: NM_000164):

```
                                       (SEQ ID NO: 1202)
ggcagcggtg gcaggggctg caggagcaag tgaccaggag
caggactggg gacaggcctg atcgcccctg cacgaaccag
acccttcgcc gccctcacga tgactacctc tccgatcctg
cagctgctgc tgcggctctc actgtgcggg ctgctgctcc
agagggcgga gacaggctct aaggggcaga cggcggggga
gctgtaccag cgctgggaac ggtaccgcag ggagtgccag
gagaccttgg cagccgcgga accgccttca ggcctcgcct
gtaacgggtc cttcgatatg tacgtctgct gggactatgc
tgcacccaat gccactgccc gtgcgtcctg cccctggtac
ctgccctggc accaccatgt ggctgcaggt ttcgtcctcc
gccagtgtgg cagtgatggc caatggggac tttggagaga
ccatacacaa tgtgagaacc cagagaagaa tgaggccttt
ctggaccaaa ggctcatctt ggagcggttg caggtcatgt
acactgtcgg ctactccctg tctctcgcca cactgctgct
agccctgctc atcttgagtt tgttcaggcg gctacattgc
actagaaact atatccacat caacctgttc acgtctttca
tgctgcgagc tgcggccatt ctcagccgag accgtctgct
acctcgacct ggcccctacc ttggggacca ggcccttgcg
ctgtggaacc aggccctcgc tgcctgccgc acggcccaga
tcgtgaccca gtactgcgtg ggtgccaact acacgtggct
```

-continued

```
gctggtggag ggcgtctacc tgcacagtct cctggtgctc
gtgggaggct ccgaggaggg ccacttccgc tactacctgc
tcctcggctg gggggccccc gcgcttttcg tcattccctg
ggtgatcgtc aggtacctgt acgagaacac gcagtgctgg
gagcgcaacg aagtcaaggc catttggtgg attatacgga
cccccatcct catgaccatc ttgattaatt tcctcatttt
tatccgcatt cttggcattc tcctgtccaa gctgaggaca
cggcaaatgc gctgccggga ttaccggctg aggctggctc
gctccacgct gacgctggtg cccctgctgg gtgtccacga
ggtggtgttt gctcccgtga cagaggaaca ggcccggggc
gccctgcgct tcgccaagct cggctttgag atcttcctca
gctccttcca gggcttcctg gtcagcgtcc tctactgctt
catcaacaag gaggtgcagt cggagatccg ccgtggctgg
caccactgcc gcctgcgccg cagcctgggc gaggagcaac
gccagctccc ggagcgcgcc ttccgggccc tgccctccgg
ctccggcccg ggcgaggtcc ccaccagccg cggcttgtcc
tcggggaccc tcccagggcc tgggaatgag gccagccggg
agttggaaag ttactgctag gggcgggat ccccgtgtct
gttcagttag catggattta ttgagtgcca actgcgtgcc
aggcccagta cggaggacgc tggggaaatg gtgaaggaaa
cagaaaaaag gtccctgccc ttctggagat gacaactgag
tggggaaaac agaccgtgaa cacaaaacat caagttccac
acacgctatg gaatggttat gaagggaagc gagaaggggg
cctagggtgg tctgggaggc gtctccaagg aggtgacact
taagccatcc ccgaaagagg tgaaagagat cactttgggg
agagctggag aacaggattc taggcggaag cgatagcata
ggcaaaggcc cttgggcagg aaggcgctca gccttggctg
gagtagaatt aagtcagagc caacaggtgg ggagagacag
agaagtgggc aggggcaccc aagttgggat ttcatttcag
gtgcattgga gattcttagg agtgtctctt gggggtaata
ttttattttt taaaaaatga ggat.
```

A 430 amino acid isoform of human GIPR (isoform X1), predicted by automated computational analysis, has the sequence (NCBI Reference Sequence XP_005258790):

(SEQ ID NO: 1203)

```
MTTSPILQLL LRLSLCGLLL QRAETGSKGQ TAGELYQRWE
RYRRECQETL AAAEPPSVAA GFVLRQCGSD GQWGLWRDHT
QCENPEKNEA FLDQRLILER LQVMYTVGYS LSLATLLLAL
LILSLFRRLH CTRNYIHINL FTSFMLRAAA ILSRDRLLPR
PGPYLGDQAL ALWNQALAAC RTAQIVTQYC VGANYTWLLV
EGVYLHSLLV LVGGSEEGHF RYYLLLGWGA PALFVIPWVI
VRYLYENTQC WERNEVKAIW WIIRTPILMT ILINFLIFIR
ILGILLSKLR TRQMRCRDYR LRLARSTLTL VPLLGVHEVV
FAPVTEEQAR GALRFAKLGF EIFLSSFQGF LVSVLYCFIN
KEVQSEIRRG WHHCRLRRSL GEEQRQLPER AFRALPSGSG
PGEVPTSRGL SSGTLPGPGN EASRELESYC
```

and is encoded by the DNA sequence:

(SEQ ID NO: 1204)

```
atgaccacca gcccgattct gcagctgctg ctgcgcctga
gcctgtgcgg cctgctgctg cagcgcgcgg aaaccggcag
caaaggccag accgcgggcg aactgtatca gcgctgggaa
cgctatcgcc gcgaatgcca ggaaaccctg gcggcggcgg
aaccgccgag cgtggcggcg ggctttgtgc tgcgccagtg
cggcagcgat ggccagtggg gcctgtggcg cgatcatacc
cagtgcgaaa acccggaaaa aaacgaagcg tttctggatc
agcgcctgat tctggaacgc ctgcaggtga tgtataccgt
gggctatagc ctgagcctgg cgaccctgct gctggcgctg
ctgattctga gcctgtttcg ccgcctgcat tgcacccgca
actatattca tattaacctg tttaccagct ttatgctgcg
cgcggcggcg attctgagcc gcgatcgcct gctgccgcgc
ccgggcccgt atctgggcga tcaggcgctg gcgctgtgga
accaggcgct ggcggcgtgc cgcaccgcgc agattgtgac
ccagtattgc gtgggcgcga actatacctg gctgctggtg
gaaggcgtgt atctgcatag cctgctggtg ctggtgggcg
gcagcgaaga aggccatttt cgctattatc tgctgctggg
ctggggcgcg ccggcgctgt ttgtgattcc gtgggtgatt
gtgcgctatc tgtatgaaaa cacccagtgc tgggaacgca
acgaagtgaa agcgatttgg tggattattc gcaccccgat
tctgatgacc attctgatta actttctgat ttttattcgc
attctgggca ttctgctgag caaactgcgc acccgccaga
tgcgctgccg cgattatcgc ctgcgcctgg cgcgcagcac
cctgaccctg gtgccgctgc tgggcgtgca tgaagtggtg
tttgcgccgg tgaccgaaga acaggcgcgc ggcgcgctgc
gctttgcgaa actgggcttt gaaatttttc tgagcagctt
tcagggcttt ctggtgagcg tgctgtattg ctttattaac
aaagaagtgc agagcgaaat tcgccgcggc tggcatcatt
gccgcctgcg ccgcagcctg ggcgaagaac agcgccagct
gccggaacgc gcgtttcgcg cgctgccgag cggcagcggc
ccgggcgaag tgccgaccag ccgcggcctg agcagcggca
ccctgccggg cccgggcaac gaagcgagcc gcgaactgga
aagctattgc.
```

A 493 amino acid isoform of human GIPR, produced by alternative splicing, has the sequence (Gremlich et al., Diabetes 44:1202-8 (1995); UniProtKB Sequence Identifier: P48546-2):

(SEQ ID NO: 1205)
MTTSPILQLL LRLSLCGLLL QRAETGSKGQ TAGELYQRWE
RYRRECQETL AAAEPPSGLA CNGSFDMYVC WDYAAPNATA
RASCPWYLPW HHHVAAGFVL RQCGSDGQWG LWRDHTQCEN
PEKNEAFLDQ RLILERLQVM YTVGYSLSLA TLLLALLILS
LFRRLHCTRN YIHINLFTSF MLRAAAILSR DRLLPRPGPY
LGDQALALWN QALAACRTAQ IVTQYCVGAN YTWLLVEGVY
LHSLLVLVGG SEEGHFRYYL LLGWGAPALF VIPWVIVRYL
YENTQCWERN EVKAIWWIIR TPILMTILIN FLIFIRILGI
LLSKLRTRQM RCRDYRLRLA RSTLTLVPLL GVHEVVFAPV
TEEQARGALR FAKLGFEIFL SSFQGFLVSV LYCFINKEVG
RDPAAAPALW RRRGTAPPLS AIVSQVQSEI RRGWHHCRLR
RSLGEEQRQL PERAFRALPS GSGPGEVPTS RGLSSGTLPG
PGNEASRELE SYC and is encoded by the DNA sequence:

(SEQ ID NO: 1206)
atgaccacca gcccgattct gcagctgctg ctgcgcctga
gcctgtgcgg cctgctgctg cagcgcgcgg aaaccggcag
caaaggccag accgcgggcg aactgtatca gcgctgggaa
cgctatcgcc gcgaatgcca ggaaaccctg gcggcggcgg
aaccgccgag cggcctggcg tgcaacggca gctttgatat
gtatgtgtgc tgggattatg cggcgccgaa cgcgaccgcg
cgcgcgagct gcccgtggta tctgccgtgg catcatcatg
tggcggcggg ctttgtgctg cgccagtgcg gcagcgatgg
ccagtggggc ctgtggcgcg atcataccca gtgcgaaaac
ccggaaaaaa acgaagcgtt tctggatcag cgcctgattc
tggaacgcct gcaggtgatg tataccgtgg gctatagcct
gagcctggcg accctgctgc tggcgctgct gattctgagc
ctgtttcgcc gcctgcattg cacccgcaac tatattcata
ttaacctgtt taccagcttt atgctgcgcg cggcggcgat
tctgagccgc gatcgcctgc tgccgcgccc gggcccgtat
ctgggcgatc aggcgctggc gctgtggaac caggcgctgg
cggcgtgccg caccgcgcag attgtgaccc agtattgcgt
gggcgcgaac tatacctggc tgctggtgga aggcgtgtat
ctgcatagcc tgctggtgct ggtgggcggc agcgaagaag
gccattttcg ctattatctg ctgctgggct ggggcgcgcc
ggcgctgttt gtgattccgt gggtgattgt gcgctatctg
tatgaaaaca cccagtgctg ggaacgcaac gaagtgaaag -continued cgatttggtg gattattcgc accccgattc tgatgaccat
tctgattaac tttctgattt ttattcgcat tctgggcatt
ctgctgagca aactgcgcac ccgccagatg cgctgccgcg
attatcgcct gcgcctggcg cgcagcaccc tgaccctggt
gccgctgctg ggcgtgcatg aagtggtgtt tgcgccggtg
accgaagaac aggcgcgcgg cgcgctgcgc tttgcgaaac
tgggctttga aatttttctg agcagctttc agggctttct
ggtgagcgtg ctgtattgct ttattaacaa agaagtgggc
cgcgatccgg cggcggcgcc ggcgctgtgg cgccgccgcg
gcaccgcgcc gccgctgagc gcgattgtga gccaggtgca
gagcgaaatt cgccgcggct ggcatcattg ccgcctgcgc
cgcagcctgg gcgaagaaca gcgccagctg ccggaacgcg
cgtttcgcgc gctgccgagc ggcagcggcc cgggcgaagt
gccgaccagc cgcggcctga gcagcggcac cctgccgggc
ccgggcaacg aagcgagccg cgaactggaa agctattgct aa The 460 amino acid sequence of murine GIPR is (NCBI Reference Sequence: NP_001074284; uniprotKB/Swiss-Prot Q0P543-1); see Vassilatis et al., PNAS USA 2003, 100:4903-4908.

(SEQ ID NO: 1207)
MPLRLLLLLL WLWGLQWAET DSEGQTTTGE LYQRWEHYGQ
ECQKMLETTE PPSGLACNGS FDMYACWNYT AANTTARVSC
PWYLPWFRQV SAGFVFRQCG SDGQWGSWRD HTQCENPEKN
GAFQDQTLIL ERLQIMYTVG YSLSLTTLLL ALLILSLFRR
LHCTRNYIHM NLFTSFMLRA AAILTRDQLL PPLGPYTGDQ
APTPWNQALA ACRTAQIMTQ YCVGANYTWL LVEGVYLHHL
LVIVGRSEKG HFRCYLLLGW GAPALFVIPW VIVRYLRENT
QCWERNEVKA IWWIIRTPIL ITILINFLIF IRILGILVSK
LRTRQMRCPD YRLRLARSTL TLVPLLGVHE VVFAPVTEEQ
VEGSLRFAKL AFEIFLSSFQ GFLVSVLYCF INKEVQSEIRQ
GWRHRRLRLS LQEQRPRPHQ ELAPRAVPLS SACREAAVGN
ALPSGMLHVP GDEVLESYC and is encoded by the DNA sequence (NCBI Reference Sequence: NM_001080815):

(SEQ ID NO: 1208)
atgccgctgc gcctgctgct gctgctgctg tggctgtggg
gcctgcagtg ggcggaaacc gatagcgaag gccagaccac
caccggcgaa ctgtatcagc gctgggaaca ttatggccag
gaatgccaga aaatgctgga aaccaccgaa ccgccgagcg
gcctggcgtg caacggcagc tttgatatgt atgcgtgctg
gaactatacc gcggcgaaca ccaccgcgcg cgtgagctgc -continued

```
ccgtggtatc tgccgtggtt tcgccaggtg agcgcgggct
ttgtgtttcg ccagtgcggc agcgatggcc agtggggcag
ctggcgcgat catacccagt gcgaaaaccc ggaaaaaaac
ggcgcgtttc aggatcagac cctgattctg gaacgcctgc
agattatgta taccgtgggc tatagcctga gcctgaccac
cctgctgctg gcgctgctga ttctgagcct gtttcgccgc
ctgcattgca cccgcaacta tattcatatg aacctgttta
ccagctttat gctgcgcgcg gcggcgattc tgacccgcga
tcagctgctg ccgccgctgg gcccgtatac cggcgatcag
gcgccgaccc cgtggaacca ggcgctggcg gcgtgccgca
ccgcgcagat tatgacccag tattgcgtgg gcgcgaacta
tacctggctg ctggtggaag gcgtgtatct gcatcatctg
ctggtgattg tgggccgcag cgaaaaaggc cattttcgct
gctatctgct gctgggctgg ggcgcgccgg cgctgtttgt
gattccgtgg gtgattgtgc gctatctgcg cgaaaacacc
cagtgctggg aacgcaacga agtgaaagcg atttggtgga
ttattcgcac cccgattctg attaccattc tgattaactt
tctgattttt attcgcattc tgggcattct ggtgagcaaa
ctgcgcaccc gccagatgcg ctgcccggat tatcgcctgc
gcctggcgcg cagcaccctg accctggtgc cgctgctggg
cgtgcatgaa gtggtgtttg cgccggtgac cgaagaacag
gtggaaggca gcctgcgctt tgcgaaactg gcgtttgaaa
tttttctgag cagctttcag ggctttctgg tgagcgtgct
gtattgcttt attaacaaag aagtgcagag cgaaattcgc
cagggctggc gccatcgccg cctgcgcctg agcctgcagg
aacagcgccc gcgcccgcat caggaactgg cgccgcgcgc
ggtgccgctg agcagcgcgt gccgcgaagc ggcggtgggc
aacgcgctgc cgagcggcat gctgcatgtg ccgggcgatg
aagtgctgga aagctattgc taa
```

A 230 amino acid isoform of murine GIPR, produced by alternative splicing, has the sequence (Gerhard et al., Genome Res, 14:2121-2127 (2004); NCBI Reference Sequence: AAI20674):

```
                                     (SEQ ID NO: 1209)
MPLRLLLLLL WLWGLQWAET DSEGQTTTGE LYQRWEHYGQ
ECQKMLETTE PPSGLACNGS FDMYACWNYT AANTTARVSC
PWYLPWFRQV SAGFVFRQCG SDGQWGSWRD HTQCENPEKN
GAFQDQTLIL ERLQIMYTVG YSLSLTTLLL ALLILSLFRR
LHCTRNYIHM NLFTSFMLRA AAILTRDQLL PPLGPYTGDQ
APTPWNQVLH RLLPGGTKTF PIYFRTFPHH
```

and is encoded by the DNA sequence:

```
                                     (SEQ ID NO: 1210)
atgccgctgc gcctgctgct gctgctgctg tggctgtggg
gcctgcagtg ggcggaaacc gatagcgaag gccagaccac
caccggcgaa ctgtatcagc gctgggaaca ttatggccag
gaatgccaga aaatgctgga aaccaccgaa ccgccgagcg
gcctggcgtg caacggcagc tttgatatgt atgcgtgctg
gaactatacc gcggcgaaca ccaccgcgcg cgtgagctgc
ccgtggtatc tgccgtggtt tcgccaggtg agcgcgggct
ttgtgtttcg ccagtgcggc agcgatggcc agtggggcag
ctggcgcgat catacccagt gcgaaaaccc ggaaaaaaac
ggcgcgtttc aggatcagac cctgattctg gaacgcctgc
agattatgta taccgtgggc tatagcctga gcctgaccac
cctgctgctg gcgctgctga ttctgagcct gtttcgccgc
ctgcattgca cccgcaacta tattcatatg aacctgttta
ccagctttat gctgcgcgcg gcggcgattc tgacccgcga
tcagctgctg ccgccgctgg gcccgtatac cggcgatcag
gcgccgaccc cgtggaacca ggtgctgcat cgcctgctgc
cgggcggcac caaaaccttt ccgatttatt ttcgcacctt
tccgcatcat taa.
```

As stated herein, the term "GIPR polypeptide" encompasses naturally occurring GIPR polypeptide sequences, e.g., human amino acid sequences SEQ ID NOs: 1201, 1203 or 1205. The term "GIPR polypeptide," however, also encompasses polypeptides comprising an amino acid sequence that differs from the amino acid sequence of a naturally occurring GIPR polypeptide sequence, e.g., SEQ ID NOs: 1201, 1203 or 1205, by one or more amino acids, such that the sequence is at least 85% identical to SEQ ID NOs: 1201, 1203 or 1205. GIPR polypeptides can be generated by introducing one or more amino acid substitutions, either conservative or non-conservative and using naturally or non-naturally occurring amino acids, at particular positions of the GIPR polypeptide.

A "conservative amino acid substitution" can involve a substitution of a native amino acid residue (i.e., a residue found in a given position of the wild-type GIPR polypeptide sequence) with a nonnative residue (i.e., a residue that is not found in a given position of the wild-type GIPR polypeptide sequence) such that there is little or no effect on the polarity or charge of the amino acid residue at that position. Conservative amino acid substitutions also encompass non-naturally occurring amino acid residues that are typically incorporated by chemical peptide synthesis rather than by synthesis in biological systems. These include peptidomimetics, and other reversed or inverted forms of amino acid moieties.

Naturally occurring residues can be divided into classes based on common side chain properties:

(1) hydrophobic: norleucine, Met, Ala, Val, Leu, Ile;
(2) neutral hydrophilic: Cys, Ser, Thr;
(3) acidic: Asp, Glu;
(4) basic: Asn, Gln, His, Lys, Arg;
(5) residues that influence chain orientation: Gly, Pro; and
(6) aromatic: Trp, Tyr, Phe.

Additional groups of amino acids can also be formulated using the principles described in, e.g., Creighton (1984) PROTEINS: STRUCTURE AND MOLECULAR PROPERTIES (2d Ed. 1993), W.H. Freeman and Company. In some instances it can be useful to further characterize substitutions based on two or more of such features (e.g., substitution with a "small polar" residue, such as a Thr residue, can represent a highly conservative substitution in an appropriate context).

Conservative substitutions can involve the exchange of a member of one of these classes for another member of the same class. Non-conservative substitutions can involve the exchange of a member of one of these classes for a member from another class.

Synthetic, rare, or modified amino acid residues having known similar physiochemical properties to those of an above-described grouping can be used as a "conservative" substitute for a particular amino acid residue in a sequence. For example, a D-Arg residue may serve as a substitute for a typical L-Arg residue. It also can be the case that a particular substitution can be described in terms of two or more of the above described classes (e.g., a substitution with a small and hydrophobic residue means substituting one amino acid with a residue(s) that is found in both of the above-described classes or other synthetic, rare, or modified residues that are known in the art to have similar physiochemical properties to such residues meeting both definitions).

Nucleic acid sequences encoding a GIPR polypeptide provided herein, including those degenerate to SEQ ID NOs: 1201, 1203 or 1205, and those encoding polypeptide variants of SEQ ID NOs: 1201, 1203 or 1205 form other aspects of the instant disclosure.

In order to express the GIPR nucleic acid sequences provided herein, the appropriate coding sequences, e.g., SEQ ID NOs: 1201, 1203 or 1205, can be cloned into a suitable vector and after introduction in a suitable host, the sequence can be expressed to produce the encoded polypeptide according to standard cloning and expression techniques, which are known in the art (e.g., as described in Sambrook, J., Fritsh, E. F., and Maniatis, T. Molecular Cloning: A Laboratory Manual 2nd, ed., Cold Spring Harbor Laboratory, Cold Spring Harbor Laboratory Press, Cold Spring Harbor, N.Y., 1989). The invention also relates to such vectors comprising a nucleic acid sequence according to the invention.

A "vector" refers to a delivery vehicle that (a) promotes the expression of a polypeptide-encoding nucleic acid sequence; (b) promotes the production of the polypeptide therefrom; (c) promotes the transfection/transformation of target cells therewith; (d) promotes the replication of the nucleic acid sequence; (e) promotes stability of the nucleic acid; (f) promotes detection of the nucleic acid and/or transformed/transfected cells; and/or (g) otherwise imparts advantageous biological and/or physiochemical function to the polypeptide-encoding nucleic acid. A vector can be any suitable vector, including chromosomal, non-chromosomal, and synthetic nucleic acid vectors (a nucleic acid sequence comprising a suitable set of expression control elements). Examples of such vectors include derivatives of SV40, bacterial plasmids, phage DNA, baculovirus, yeast plasmids, vectors derived from combinations of plasmids and phage DNA, and viral nucleic acid (RNA or DNA) vectors.

A recombinant expression vector can be designed for expression of a GIPR protein in prokaryotic (e.g., *E. coli*) or eukaryotic cells (e.g., insect cells, using baculovirus expression vectors, yeast cells, or mammalian cells). In one embodiment the host cell is a mammalian, non-human host cell. Representative host cells include those hosts typically used for cloning and expression, including *Escherichia coli* strains TOP10F', TOP10, DH10B, DH5a, HB101, W3110, BL21(DE3) and BL21 (DE3)pLysS, BLUESCRIPT (Stratagene), mammalian cell lines CHO, CHO-K1, HEK293, 293-EBNA pIN vectors (Van Heeke & Schuster, J. Biol. Chem. 264: 5503-5509 (1989); pET vectors (Novagen, Madison Wis.). Alternatively, the recombinant expression vector can be transcribed and translated in vitro, for example using T7 promoter regulatory sequences and T7 polymerase and an in vitro translation system. Preferably, the vector contains a promoter upstream of the cloning site containing the nucleic acid sequence encoding the polypeptide. Examples of promoters, which can be switched on and off, include the lac promoter, the T7 promoter, the trc promoter, the tac promoter and the trp promoter.

Thus, provided herein are vectors comprising a nucleic acid sequence encoding GIPR that facilitate the expression of recombinant GIPR. In various embodiments, the vectors comprise an operably linked nucleotide sequence which regulates the expression of GIPR. A vector can comprise or be associated with any suitable promoter, enhancer, and other expression-facilitating elements. Examples of such elements include strong expression promoters (e.g., a human CMV IE promoter/enhancer, an RSV promoter, SV40 promoter, SL3-3 promoter, MMTV promoter, or HIV LTR promoter, EF1alpha promoter, CAG promoter), effective poly (A) termination sequences, an origin of replication for plasmid product in *E. coli*, an antibiotic resistance gene as a selectable marker, and/or a convenient cloning site (e.g., a polylinker). Vectors also can comprise an inducible promoter as opposed to a constitutive promoter such as CMV IE. In one aspect, a nucleic acid comprising a sequence encoding a GIPR polypeptide which is operatively linked to a tissue specific promoter which promotes expression of the sequence in a metabolically-relevant tissue, such as liver or pancreatic tissue is provided.

In another aspect of the instant disclosure, host cells comprising the GIPR nucleic acids and vectors disclosed herein are provided. In various embodiments, the vector or nucleic acid is integrated into the host cell genome, which in other embodiments the vector or nucleic acid is extra-chromosomal.

Recombinant cells, such as yeast, bacterial (e.g., *E. coli*), and mammalian cells (e.g., immortalized mammalian cells) comprising such a nucleic acid, vector, or combinations of either or both thereof are provided. In various embodiments cells comprising a non-integrated nucleic acid, such as a plasmid, cosmid, phagemid, or linear expression element, which comprises a sequence coding for expression of a GIPR polypeptide, are provided.

A vector comprising a nucleic acid sequence encoding a GIPR polypeptide provided herein can be introduced into a host cell by transformation or by transfection. Methods of transforming a cell with an expression vector are well known.

A GIPR-encoding nucleic acid can be positioned in and/or delivered to a host cell or host animal via a viral vector. Any suitable viral vector can be used in this capacity. A viral vector can comprise any number of viral polynucleotides, alone or in combination with one or more viral proteins, which facilitate delivery, replication, and/or expression of the nucleic acid of the invention in a desired host cell. The viral vector can be a polynucleotide comprising all or part of a viral genome, a viral protein/nucleic acid conjugate, a virus-like particle (VLP), or an intact virus particle comprising viral nucleic acids and a GIPR polypeptide-encoding nucleic acid. A viral particle viral vector can comprise a wild-type viral particle or a modified viral particle. The viral vector can be a vector which requires the presence of another vector or wild-type virus for replication and/or expression (e.g., a viral vector can be a helper-dependent virus), such as an adenoviral vector amplicon. Typically, such viral vectors consist of a wild-type viral particle, or a viral particle modified in its protein and/or nucleic acid content to increase transgene capacity or aid in transfection and/or expression of the nucleic acid (examples of such vectors include the herpes virus/AAV amplicons). Typically, a viral vector is similar to and/or derived from a virus that normally infects humans. Suitable viral vector particles in this respect, include, for example, adenoviral vector particles (including any virus of or derived from a virus of the adenoviridae), adeno-associated viral vector particles (AAV vector particles) or other parvoviruses and parvoviral vector particles, papillomaviral vector particles, flaviviral vectors, alphaviral vectors, herpes viral vectors, pox virus vectors, retroviral vectors, including lentiviral vectors.

A GIPR polypeptide expressed as described herein can be isolated using standard protein purification methods. A GIPR polypeptide can be isolated from a cell in which is it naturally expressed or it can be isolated from a cell that has been engineered to express GIPR, for example a cell that does not naturally express GIPR.

Protein purification methods that can be employed to isolate a GIPR polypeptide, as well as associated materials and reagents, are known in the art. Additional purification methods that may be useful for isolating a GIPR polypeptide can be found in references such as Bootcov M R, 1997, Proc. Natl. Acad. Sci. USA 94:11514-9, Fairlie W D, 2000, Gene 254: 67-76.

Antagonist antigen binding proteins that bind GIPR, including human GIPR (hGIPR) are provided herein. In one embodiment, the human GIPR has the sequence as such as set forth in SEQ ID NO: 1201. In another embodiment, the human GIPR has the sequence as such set forth in SEQ ID NO: 1203. In another embodiment, the human GIPR has the sequence as such set forth in SEQ ID NO: 1205.

The antigen binding proteins provided are polypeptides into which one or more complementary determining regions (CDRs), as described herein, are embedded and/or joined. In some antigen binding proteins, the CDRs are embedded into a "framework" region, which orients the CDR(s) such that the proper antigen binding properties of the CDR(s) are achieved. Certain antigen binding proteins described herein are antibodies or are derived from antibodies. In other antigen binding proteins, the CDR sequences are embedded in a different type of protein scaffold. The various structures are further described below.

The antigen binding proteins that are disclosed herein have a variety of utilities. The antigen binding proteins, for instance, are useful in specific binding assays, affinity purification of GIPR, and in screening assays to identify other antagonists of GIPR activity. Other uses for the antigen binding proteins include, for example, diagnosis of GIPR-associated diseases or conditions and screening assays to determine the presence or absence of GIPR. Given that the antigen binding proteins that are provided are antagonists, the GIPR antigen binding proteins have value in therapeutic methods in which it is useful to reduce weight gain, even while maintaining or increasing food intake, increasing % fat mass and increasing % lean mass, improving glucose tolerance, decreasing insulin levels, decreasing cholesterol and triglyceride levels. Accordingly, the antigen binding proteins have utility in the treatment and prevention of diabetes, e.g., type 2 diabetes, obesity, dyslipidemia, elevated glucose levels or elevated insulin levels.

A variety of selective binding agents useful for modulating the activity of GIPR are provided. These agents include, for instance, antigen binding proteins that contain an antigen binding domain (e.g., scFvs, domain antibodies, and polypeptides with an antigen binding region) and specifically bind to a GIPR polypeptide, in particular human GIPR. Some of the agents, for example, are useful in enhancing the activity of GIPR, and can activate one or more activities associated with GIPR.

In general the antigen binding proteins that are provided typically comprise one or more CDRs as described herein (e.g., 1, 2, 3, 4, 5 or 6). In some instances, the antigen binding protein comprises (a) a polypeptide structure and (b) one or more CDRs that are inserted into and/or joined to the polypeptide structure. The polypeptide structure can take a variety of different forms. For example, it can be, or comprise, the framework of a naturally occurring antibody, or fragment or variant thereof, or may be completely synthetic in nature. Examples of various polypeptide structures are further described below.

In certain embodiments, the polypeptide structure of the antigen binding proteins is an antibody or is derived from an antibody. Accordingly, examples of certain antigen binding proteins that are provided include, but are not limited to, monoclonal antibodies, bispecific antibodies, minibodies, domain antibodies such as Nanobodies®, synthetic antibodies (sometimes referred to herein as "antibody mimetics"), chimeric antibodies, humanized antibodies, human antibodies, antibody fusions, and portions or fragments of each, respectively. In some instances, the antigen binding protein is an immunological fragment of a complete antibody (e.g., a Fab, a Fab', a F(ab')2). In other instances the antigen binding protein is a scFv that uses CDRs from an antibody of the present invention.

The antigen binding proteins as provided herein specifically bind to a human GIPR. In a specific embodiment, the antigen binding protein specifically binds to human GIPR comprising or consisting of the amino acid sequence of SEQ ID NO: 1201. In a specific embodiment, the antigen binding protein specifically binds to human GIPR comprising or consisting of the amino acid sequence of SEQ ID NO: 1203. In a specific embodiment, the antigen binding protein specifically binds to human GIPR comprising or consisting of the amino acid sequence of SEQ ID NO: 1205.

The antigen binding proteins that are provided are antagonists and typically have one, two, three, four, five, six, seven or all eight of the following characteristics:

(a) ability to prevent or reduce binding of GIP to GIPR, where the levels can be measured, for example, by the methods such as radioactive- or fluorescence-labeled ligand binding study, or by the methods described herein (e.g. cAMP assay or other functional assays). The decrease can be at least 10, 25, 50, 100% or more relative to the pretreatment levels of SEQ ID NO: 1201, 1203 or 1205 under comparable conditions.

(b) ability to decrease blood glucose;

(c) ability to increase glucose tolerance;

(d) ability to increase insulin sensitivity;

(e) ability to decrease body weight or reduce body weight gain;

(f) ability to decrease fat mass or decrease inflammation in fat tissue;

(g) ability to decrease fasting insulin levels;

(h) ability to decrease circulating cholesterol levels;

(i) ability to decrease circulating triglyceride levels;
(j) ability to decrease liver steatosis or reduce triglyceride level in liver;
(k) ability to decrease AST, ALT, and/or ALP levels.

In one embodiment, a GIPR antigen binding protein has one or more of the following activities:

(a) binds human GIPR such that KD is ≤200 nM, is ≤150 nM, is ≤100 nM, is ≤50 nM, is ≤10 nM, is ≤5 nM, is ≤2 nM, or is ≤1 nM, e.g., as measured via a surface plasma resonance or kinetic exclusion assay technique.
(b) has a half-life in human serum of at least 3 days;

Some antigen binding proteins that are provided have an on-rate (ka) for GIPR of at least $10^4$/M× seconds, at least $10^5$/M× seconds, or at least $10^6$/M× seconds as measured, for instance, as described below. Certain antigen binding proteins that are provided have a slow dissociation rate or off-rate. Some antigen binding proteins, for instance, have a kd (off-rate) of $1\times10^{-2}$ $s^{-1}$, or $1\times10^{-3}$ $s^{-1}$, or $1\times10^{-4}$ $s^{-1}$, or $1\times10^{-5}$ $s^{-1}$. In certain embodiments, the antigen binding protein has a KD (equilibrium binding affinity) of less than 25 pM, 50 pM, 100 pM, 500 pM, 1 nM, 5 nM, 10 nM, 25 nM or 50 nM.

Depending on the assay, the binding of an antigen binding protein to its target can also be measured as an EC50 (the concentration of antigen binding protein that gives a half-maximal response when bound to target). An EC50 for an anti-GIPR antigen binding protein of the present invention can be determined by incubating different concentrations of antigen binding protein with cells expressing GIPR. Anti-GIPR antigen binding proteins of the present invention can have EC50s less 200 nM, 150 nM, 125 nM, 100 nM, 90 nM, 80 nM, 70 nM, 60 nM, 50 nM, 40 nM, or 30 nM.

An IC50 (the half maximal inhibitory concentration: a measure of the effectiveness of an antigen binding protein in inhibiting a specific biological or biochemical function) can also be used to measure the activity of anti-GIPR antigen binding protein. An IC 50 can be measured using a functional assay. For example, such an assay can be used for the quantitative determination of cAMP in HEK 293T cells expressing the human GIPR or cynomolgus monkey GIPR. GIP binding causes GIPR conformation change, stimulating the G protein to active adenylate cyclase resulting in cAMP production from ATP. Antibody binding to GIPR prevents GIP binding to GIPR with the result being less cAMP. This is measurable by a cAMP assay. Anti-GIPR antigen binding proteins of the present invention can have IC50s less 200 nM, 150 nM, 125 nM, 100 nM, 90 nM, 80 nM, 70 nM, 60 nM, 50 nM, 40 nM, 30 nM, 29 nM, 28 nM, 27 nM, 26 nM, 25 nM, 24 nM, 23 nM, 22 nM, 21 mM, 20 nM, 19 nM, 18 nM, 17 nM, 16 nM, 15 nM, 14 nM, 13 nM, 12 nM, 11 mM, 10 nM, 9 nM, 8 nM, 7 nM, 6 nM, 5 nM, 4 nM, 3 nM, 2 nM, or 1 nM.

In another aspect, an antigen-binding protein is provided having a half-life of at least one day in vitro or in vivo (e.g., when administered to a human subject). In one embodiment, the antigen binding protein has a half-life of at least three days. In various other embodiments, the antigen binding protein has a half-life of 4, 5, 6, 7, 8, 9, 10, 15, 20, 25, 30, 40, 50, or 60 days or longer. In another embodiment, the antigen binding protein is derivatized or modified such that it has a longer half-life as compared to the underivatized or unmodified antibody. In another embodiment, the antigen binding protein contains point mutations to increase serum half-life. Further details regarding such mutant and derivatized forms are provided below.

Some of the antigen binding proteins that are provided have the structure typically associated with naturally occurring antibodies. The structural units of these antibodies typically comprise one or more tetramers, each composed of two identical couplets of polypeptide chains, though some species of mammals also produce antibodies having only a single heavy chain. In a typical antibody, each pair or couplet includes one full-length "light" chain (in certain embodiments, about 25 kDa) and one full-length "heavy" chain (in certain embodiments, about 50-70 kDa). Each individual immunoglobulin chain is composed of several "immunoglobulin domains", each consisting of roughly 90 to 110 amino acids and expressing a characteristic folding pattern. These domains are the basic units of which antibody polypeptides are composed. The amino-terminal portion of each chain typically includes a variable domain that is responsible for antigen recognition. The carboxy-terminal portion is more conserved evolutionarily than the other end of the chain and is referred to as the "constant region" or "C region". Human light chains generally are classified as kappa and lambda light chains, and each of these contains one variable domain and one constant domain. Heavy chains are typically classified as mu, delta, gamma, alpha, or epsilon chains, and these define the antibody's isotype as IgM, IgD, IgG, IgA, and IgE, respectively. IgG has several subtypes, including, but not limited to, IgG1, IgG2, IgG3, and IgG4. IgM subtypes include IgM, and IgM2. IgA subtypes include IgA1 and IgA2. In humans, the IgA and IgD isotypes contain four heavy chains and four light chains; the IgG and IgE isotypes contain two heavy chains and two light chains; and the IgM isotype contains five heavy chains and five light chains. The heavy chain C region typically comprises one or more domains that may be responsible for effector function. The number of heavy chain constant region domains will depend on the isotype. IgG heavy chains, for example, each contain three C region domains known as CH1, CH2 and CH3. The antibodies that are provided can have any of these isotypes and subtypes. In certain embodiments, the GIPR antibody is of the IgG1, IgG2, or IgG4 subtype. The terms "GIPR antibody" and "anti-GIPR antibody" are used interchangeably throughout this application and FIGURES. Both terms refer to an antibody that binds to GIPR.

In full-length light and heavy chains, the variable and constant regions are joined by a "J" region of about twelve or more amino acids, with the heavy chain also including a "D" region of about ten more amino acids. See, e.g. Fundamental Immunology, 2nd ed., Ch. 7 (Paul, W., ed.) 1989, New York: Raven Press (hereby incorporated by reference in its entirety for all purposes). The variable regions of each light/heavy chain pair typically form the antigen binding site.

For the antibodies provided herein, the variable regions of immunoglobulin chains generally exhibit the same overall structure, comprising relatively conserved framework regions (FR) joined by three hypervariable regions, more often called "complementarity determining regions" or CDRs. The CDRs from the two chains of each heavy chain/light chain pair mentioned above typically are aligned by the framework regions to form a structure that binds specifically with a specific epitope on GIPR. From N-terminal to C-terminal, naturally-occurring light and heavy chain variable regions both typically conform with the following order of these elements: FR1, CDR1, FR2, CDR2, FR3, CDR3 and FR4. A numbering system has been devised for assigning numbers to amino acids that occupy positions in each of these domains. This numbering system is defined in Kabat Sequences of Proteins of Immunological Interest (1987 and 1991, NIH, Bethesda, Md.), or Chothia & Lesk, 1987, J. Mol. Biol. 196:901-917; Chothia et al., 1989, Nature 342:878-883.

The sequence information for specific antibodies prepared and identified as described in the Examples below is summarized in TABLE 1. Thus, in an embodiment, an antigen binding protein is an antibody with the CDR, variable domain and light and heavy chain sequences as specified in one of the rows of TABLE 1.

SEQ ID NOs have been assigned to variable light chain, variable heavy chain, light chain, heavy chain, CDRL1, CDRL2, CDRL3, CDRH1, CDRH2, and CDRH3 sequences of the antibodies and fragments thereof of the present invention and are shown in TABLE 1. SEQ ID NOs have also been assigned to polynucleotides encoding the variable light chain, variable heavy chain, light chain, heavy chain, CDRL1, CDRL2, CDRL3, CDRH1, CDRH2, and CDRH3 sequences of the antibodies and fragments thereof of the present invention and are shown in TABLE 2. The antigen binding proteins of the present invention can be identified by SEQ ID NO, but also by construct name (e.g., 2C2.005) or identifier number (e.g., iPS:336175). The antigen binding proteins identified in Tables 1-5 below can be grouped into families based on construct name. For example, the "4B1 family" includes the constructs 4B1, 4B1.010, 4B1.011, 4B1.012, 4B1.013, 4B1.014, 4B1.015, and 4B1.016.

The various light chain and heavy chain variable regions provided herein are depicted in TABLE 3. Each of these variable regions may be attached to a heavy or light chain constant regions to form a complete antibody heavy and light chain, respectively. Furthermore, each of the so generated heavy and light chain sequences may be combined to form a complete antibody structure.

TABLE 1

| | Amino acid SEQ ID NOs. | | | | | | | | | |
|---|---|---|---|---|---|---|---|---|---|---|
| Construct | VL | VH | LC | HC | CDRL1 | CDRL2 | CDRL3 | CDRH1 | CDRH2 | CDRH3 |
| 2G10.303 | 723 | 724 | 963 | 964 | 4 | 5 | 6 | 364 | 365 | 366 |
| 2G10.304 | 727 | 728 | 967 | 968 | 10 | 11 | 12 | 370 | 371 | 372 |
| 2G10.323 | 731 | 732 | 971 | 972 | 16 | 17 | 18 | 376 | 377 | 378 |
| 2G10.309 | 735 | 736 | 975 | 976 | 22 | 23 | 24 | 382 | 383 | 384 |
| 2G10.316 | 739 | 740 | 979 | 980 | 28 | 29 | 30 | 388 | 389 | 390 |
| 2G10.604 | 743 | 744 | 983 | 984 | 34 | 35 | 36 | 394 | 395 | 396 |
| 2G10.609 | 747 | 748 | 987 | 988 | 40 | 41 | 42 | 400 | 401 | 402 |
| 2G10.603 | 751 | 752 | 991 | 992 | 46 | 47 | 48 | 406 | 407 | 408 |
| 2G10.318 | 755 | 756 | 995 | 996 | 52 | 53 | 54 | 412 | 413 | 414 |
| 2G10.324 | 759 | 760 | 999 | 1000 | 58 | 59 | 60 | 418 | 419 | 420 |
| 2G10.322 | 763 | 764 | 1003 | 1004 | 64 | 65 | 66 | 424 | 425 | 426 |
| 2G10.315 | 767 | 768 | 1007 | 1008 | 70 | 71 | 72 | 430 | 431 | 432 |
| 2G10.331 | 771 | 772 | 1011 | 1012 | 76 | 77 | 78 | 436 | 437 | 438 |
| 2G10.320 | 775 | 776 | 1015 | 1016 | 82 | 83 | 84 | 442 | 443 | 444 |
| 2G10.328 | 779 | 780 | 1019 | 1020 | 88 | 89 | 90 | 448 | 449 | 450 |
| 2G10.333 | 783 | 784 | 1023 | 1024 | 94 | 95 | 96 | 454 | 455 | 456 |
| 2G10.301 | 787 | 788 | 1027 | 1028 | 100 | 101 | 102 | 460 | 461 | 462 |
| 2G10.601 | 791 | 792 | 1031 | 1032 | 106 | 107 | 108 | 466 | 467 | 468 |
| 2G10.326 | 795 | 796 | 1035 | 1036 | 112 | 113 | 114 | 472 | 473 | 474 |
| 2G10.308 | 799 | 800 | 1039 | 1040 | 118 | 119 | 120 | 478 | 479 | 480 |
| 2G10.608 | 803 | 804 | 1043 | 1044 | 124 | 125 | 126 | 484 | 485 | 486 |
| 2G10.336 | 807 | 808 | 1047 | 1048 | 130 | 131 | 132 | 490 | 491 | 492 |
| 2G10.344 | 811 | 812 | 1051 | 1052 | 136 | 137 | 138 | 496 | 497 | 498 |
| 2G10.310 | 815 | 816 | 1055 | 1056 | 142 | 143 | 144 | 502 | 503 | 504 |
| 2G10.610 | 819 | 820 | 1059 | 1060 | 148 | 149 | 150 | 508 | 509 | 510 |
| 2G10.312 | 823 | 824 | 1063 | 1064 | 154 | 155 | 156 | 514 | 515 | 516 |
| 2G10.329 | 827 | 828 | 1067 | 1068 | 160 | 161 | 162 | 520 | 521 | 522 |
| 2G10.327 | 831 | 832 | 1071 | 1072 | 166 | 167 | 168 | 526 | 527 | 528 |
| 2G10.338 | 835 | 836 | 1075 | 1076 | 172 | 173 | 174 | 532 | 533 | 534 |
| 2G10.314 | 839 | 840 | 1079 | 1080 | 178 | 179 | 180 | 538 | 539 | 540 |
| 2G10.337 | 843 | 844 | 1083 | 1084 | 184 | 185 | 186 | 544 | 545 | 546 |
| 2G10.341 | 847 | 848 | 1087 | 1088 | 190 | 191 | 192 | 550 | 551 | 552 |
| 2G10.302 | 851 | 852 | 1091 | 1092 | 196 | 197 | 198 | 556 | 557 | 558 |
| 2G10.602 | 855 | 856 | 1095 | 1096 | 202 | 203 | 204 | 562 | 563 | 564 |
| 2G10.325 | 859 | 860 | 1099 | 1100 | 208 | 209 | 210 | 568 | 569 | 570 |
| 2G10.343 | 863 | 864 | 1103 | 1104 | 214 | 215 | 216 | 574 | 575 | 576 |
| 2G10.313 | 867 | 868 | 1107 | 1108 | 220 | 221 | 222 | 580 | 581 | 582 |
| 2G10.317 | 871 | 872 | 1111 | 1112 | 226 | 227 | 228 | 586 | 587 | 588 |
| 2G10.311 | 875 | 876 | 1115 | 1116 | 232 | 233 | 234 | 592 | 593 | 594 |
| 2G10.306 | 879 | 880 | 1119 | 1120 | 238 | 239 | 240 | 598 | 599 | 600 |
| 2G10.606 | 883 | 884 | 1123 | 1124 | 244 | 245 | 246 | 604 | 605 | 606 |
| 2G10.347 | 887 | 888 | 1127 | 1128 | 250 | 251 | 252 | 610 | 611 | 612 |
| 2G10.348 | 891 | 892 | 1131 | 1132 | 256 | 257 | 258 | 616 | 617 | 618 |
| 2G10.346 | 895 | 896 | 1135 | 1136 | 262 | 263 | 264 | 622 | 623 | 624 |
| 2G10.647 | 899 | 900 | 1139 | 1140 | 268 | 269 | 270 | 628 | 629 | 630 |
| 2G10.649 | 903 | 904 | 1143 | 1144 | 274 | 275 | 276 | 634 | 635 | 636 |
| 2G10.305 | 907 | 908 | 1147 | 1148 | 280 | 281 | 282 | 640 | 641 | 642 |
| 2G10.605 | 911 | 912 | 1151 | 1152 | 286 | 287 | 288 | 646 | 647 | 648 |
| 2G10.340 | 915 | 916 | 1155 | 1156 | 292 | 293 | 294 | 652 | 653 | 654 |
| 2G10.334 | 919 | 920 | 1159 | 1160 | 298 | 299 | 300 | 658 | 659 | 660 |
| 2G10.339 | 923 | 924 | 1163 | 1164 | 304 | 305 | 306 | 664 | 665 | 666 |
| 2G10.307 | 927 | 928 | 1167 | 1168 | 310 | 311 | 312 | 670 | 671 | 672 |
| 2G10.607 | 931 | 932 | 1171 | 1172 | 316 | 317 | 318 | 676 | 677 | 678 |
| 2G10.321 | 935 | 936 | 1175 | 1176 | 322 | 323 | 324 | 682 | 683 | 684 |

TABLE 1-continued

| Amino acid SEQ ID NOs. | | | | | | | | | | |
|---|---|---|---|---|---|---|---|---|---|---|
| Construct | VL | VH | LC | HC | CDRL1 | CDRL2 | CDRL3 | CDRH1 | CDRH2 | CDRH3 |
| 2G10.342 | 939 | 940 | 1179 | 1180 | 328 | 329 | 330 | 688 | 689 | 690 |
| 2G10.319 | 943 | 944 | 1183 | 1184 | 334 | 335 | 336 | 694 | 695 | 696 |
| 2G10.332 | 947 | 948 | 1187 | 1188 | 340 | 341 | 342 | 700 | 701 | 702 |
| 2G10.345 | 951 | 952 | 1191 | 1192 | 346 | 347 | 348 | 706 | 707 | 708 |
| 2G10.335 | 955 | 956 | 1195 | 1196 | 352 | 353 | 354 | 712 | 713 | 714 |
| 2G10.330 | 959 | 960 | 1199 | 1200 | 358 | 359 | 360 | 718 | 719 | 720 |
| iPS:529381 | 1286 | 1287 | 1288 | 1289 | 1290 | 1291 | 1292 | 1293 | 1294 | 1295 |
| iPS:529382 | 1296 | 1297 | 1298 | 1299 | 1300 | 1301 | 1302 | 1303 | 1304 | 1305 |
| iPS:529397 | 1306 | 1307 | 1308 | 1309 | 1310 | 1311 | 1312 | 1313 | 1314 | 1315 |
| iPS:529399 | 1316 | 1317 | 1318 | 1319 | 1320 | 1321 | 1322 | 1323 | 1324 | 1325 |
| iPS:529400 | 1326 | 1327 | 1328 | 1329 | 1330 | 1331 | 1332 | 1333 | 1334 | 1335 |
| iPS:529403 | 1336 | 1337 | 1338 | 1339 | 1340 | 1341 | 1342 | 1343 | 1344 | 1345 |
| iPS:529404 | 1346 | 1347 | 1348 | 1349 | 1350 | 1351 | 1352 | 1353 | 1354 | 1355 |
| iPS:529405 | 1356 | 1357 | 1358 | 1359 | 1360 | 1351 | 1352 | 1353 | 1354 | 1355 |

TABLE 2

| Nucleic acid SEQ ID NOs. | | | | | | | | | | |
|---|---|---|---|---|---|---|---|---|---|---|
| Construct | VL | VH | LC | HC | CDRL1 | CDRL2 | CDRL3 | CDRH1 | CDRH2 | CDRH3 |
| 2G10.303 | 721 | 722 | 961 | 962 | 1 | 2 | 3 | 361 | 362 | 363 |
| 2G10.304 | 725 | 726 | 965 | 966 | 7 | 8 | 9 | 367 | 368 | 369 |
| 2G10.323 | 729 | 730 | 969 | 970 | 13 | 14 | 15 | 373 | 374 | 375 |
| 2G10.309 | 733 | 734 | 973 | 974 | 19 | 20 | 21 | 379 | 380 | 381 |
| 2G10.316 | 737 | 738 | 977 | 978 | 25 | 26 | 27 | 385 | 386 | 387 |
| 2G10.604 | 741 | 742 | 981 | 982 | 31 | 32 | 33 | 391 | 392 | 393 |
| 2G10.609 | 745 | 746 | 985 | 986 | 37 | 38 | 39 | 397 | 398 | 399 |
| 2G10.603 | 749 | 750 | 989 | 990 | 43 | 44 | 45 | 403 | 404 | 405 |
| 2G10.318 | 753 | 754 | 993 | 994 | 49 | 50 | 51 | 409 | 410 | 411 |
| 2G10.324 | 757 | 758 | 997 | 998 | 55 | 56 | 57 | 415 | 416 | 417 |
| 2G10.322 | 761 | 762 | 1001 | 1002 | 61 | 62 | 63 | 421 | 422 | 423 |
| 2G10.315 | 765 | 766 | 1005 | 1006 | 67 | 68 | 69 | 427 | 428 | 429 |
| 2G10.331 | 769 | 770 | 1009 | 1010 | 73 | 74 | 75 | 433 | 434 | 435 |
| 2G10.320 | 773 | 774 | 1013 | 1014 | 79 | 80 | 81 | 439 | 440 | 441 |
| 2G10.328 | 777 | 778 | 1017 | 1018 | 85 | 86 | 87 | 445 | 446 | 447 |
| 2G10.333 | 781 | 782 | 1021 | 1022 | 91 | 92 | 93 | 451 | 452 | 453 |
| 2G10.301 | 785 | 786 | 1025 | 1026 | 97 | 98 | 99 | 457 | 458 | 459 |
| 2G10.601 | 789 | 790 | 1029 | 1030 | 103 | 104 | 105 | 463 | 464 | 465 |
| 2G10.326 | 793 | 794 | 1033 | 1034 | 109 | 110 | 111 | 469 | 470 | 471 |
| 2G10.308 | 797 | 798 | 1037 | 1038 | 115 | 116 | 117 | 475 | 476 | 477 |
| 2G10.608 | 801 | 802 | 1041 | 1042 | 121 | 122 | 123 | 481 | 482 | 483 |
| 2G10.336 | 805 | 806 | 1045 | 1046 | 127 | 128 | 129 | 487 | 488 | 489 |
| 2G10.344 | 809 | 810 | 1049 | 1050 | 133 | 134 | 135 | 493 | 494 | 495 |
| 2G10.310 | 813 | 814 | 1053 | 1054 | 139 | 140 | 141 | 499 | 500 | 501 |
| 2G10.610 | 817 | 818 | 1057 | 1058 | 145 | 146 | 147 | 505 | 506 | 507 |
| 2G10.312 | 821 | 822 | 1061 | 1062 | 151 | 152 | 153 | 511 | 512 | 513 |
| 2G10.329 | 825 | 826 | 1065 | 1066 | 157 | 158 | 159 | 517 | 518 | 519 |
| 2G10.327 | 829 | 830 | 1069 | 1070 | 163 | 164 | 165 | 523 | 524 | 525 |
| 2G10.338 | 833 | 834 | 1073 | 1074 | 169 | 170 | 171 | 529 | 530 | 531 |
| 2G10.314 | 837 | 838 | 1077 | 1078 | 175 | 176 | 177 | 535 | 536 | 537 |
| 2G10.337 | 841 | 842 | 1081 | 1082 | 181 | 182 | 183 | 541 | 542 | 543 |
| 2G10.341 | 845 | 846 | 1085 | 1086 | 187 | 188 | 189 | 547 | 548 | 549 |
| 2G10.302 | 849 | 850 | 1089 | 1090 | 193 | 194 | 195 | 553 | 554 | 555 |
| 2G10.602 | 853 | 854 | 1093 | 1094 | 199 | 200 | 201 | 559 | 560 | 561 |
| 2G10.325 | 857 | 858 | 1097 | 1098 | 205 | 206 | 207 | 565 | 566 | 567 |
| 2G10.343 | 861 | 862 | 1101 | 1102 | 211 | 212 | 213 | 571 | 572 | 573 |
| 2G10.313 | 865 | 866 | 1105 | 1106 | 217 | 218 | 219 | 577 | 578 | 579 |
| 2G10.317 | 869 | 870 | 1109 | 1110 | 223 | 224 | 225 | 583 | 584 | 585 |
| 2G10.311 | 873 | 874 | 1113 | 1114 | 229 | 230 | 231 | 589 | 590 | 591 |
| 2G10.306 | 877 | 878 | 1117 | 1118 | 235 | 236 | 237 | 595 | 596 | 597 |
| 2G10.606 | 881 | 882 | 1121 | 1122 | 241 | 242 | 243 | 601 | 602 | 603 |
| 2G10.347 | 885 | 886 | 1125 | 1126 | 247 | 248 | 249 | 607 | 608 | 609 |
| 2G10.348 | 889 | 890 | 1129 | 1130 | 253 | 254 | 255 | 613 | 614 | 615 |
| 2G10.346 | 893 | 894 | 1133 | 1134 | 259 | 260 | 261 | 619 | 620 | 621 |
| 2G10.647 | 897 | 898 | 1137 | 1138 | 265 | 266 | 267 | 625 | 626 | 627 |
| 2G10.649 | 901 | 902 | 1141 | 1142 | 271 | 272 | 273 | 631 | 632 | 633 |
| 2G10.305 | 905 | 906 | 1145 | 1146 | 277 | 278 | 279 | 637 | 638 | 639 |
| 2G10.605 | 909 | 910 | 1149 | 1150 | 283 | 284 | 285 | 643 | 644 | 645 |
| 2G10.340 | 913 | 914 | 1153 | 1154 | 289 | 290 | 291 | 649 | 650 | 651 |
| 2G10.334 | 917 | 918 | 1157 | 1158 | 295 | 296 | 297 | 655 | 656 | 657 |
| 2G10.339 | 921 | 922 | 1161 | 1162 | 301 | 302 | 303 | 661 | 662 | 663 |
| 2G10.307 | 925 | 926 | 1165 | 1166 | 307 | 308 | 309 | 667 | 668 | 669 |

TABLE 2-continued

| Nucleic acid SEQ ID NOs. | | | | | | | | | | |
|---|---|---|---|---|---|---|---|---|---|---|
| Construct | VL | VH | LC | HC | CDRL1 | CDRL2 | CDRL3 | CDRH1 | CDRH2 | CDRH3 |
| 2G10.607 | 929 | 930 | 1169 | 1170 | 313 | 314 | 315 | 673 | 674 | 675 |
| 2G10.321 | 933 | 934 | 1173 | 1174 | 319 | 320 | 321 | 679 | 680 | 681 |
| 2G10.342 | 937 | 938 | 1177 | 1178 | 325 | 326 | 327 | 685 | 686 | 687 |
| 2G10.319 | 941 | 942 | 1181 | 1182 | 331 | 332 | 333 | 691 | 692 | 693 |
| 2G10.332 | 945 | 946 | 1185 | 1186 | 337 | 338 | 339 | 697 | 698 | 699 |
| 2G10.345 | 949 | 950 | 1189 | 1190 | 343 | 344 | 345 | 703 | 704 | 705 |
| 2G10.335 | 953 | 954 | 1193 | 1194 | 349 | 350 | 351 | 709 | 710 | 711 |
| 2G10.330 | 957 | 958 | 1197 | 1198 | 355 | 356 | 357 | 715 | 716 | 717 |
| iPS:529381 | 1377 | 1378 | 1361 | 1362 | | | | | | |
| iPS:529382 | 1379 | 1380 | 1363 | 1364 | | | | | | |
| iPS:529397 | 1381 | 1382 | 1365 | 1366 | | | | | | |
| iPS:529399 | 1383 | 1384 | 1367 | 1368 | | | | | | |
| iPS:529400 | 1385 | 1386 | 1369 | 1370 | | | | | | |
| iPS:529403 | 1387 | 1388 | 1371 | 1372 | | | | | | |
| iPS:529404 | 1389 | 1390 | 1373 | 1374 | | | | | | |
| iPS:529405 | 1391 | 1392 | 1375 | 1376 | | | | | | |

TABLE 3

| Exemplary Variable Light and Variable Heavy Regions: Nucleic Acid ("NA") and Amino Acid ("AA") Sequences | | | |
|---|---|---|---|
| Ab | Type | LC V-region | HC V-region |
| 2G10.303 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTGATAGACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGAACTGGCCTCT<br>CACTTTCGGCGGAGGGACCAAGGTGGAGATCAAA<br>(SEQ ID NO: 721) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 722) |
| | AA | EIVMTQSPATLSVSPGERATLSCRASQSVDRHLAWYQ<br>QKPGQAPRLLIYEAATRATGIPARFSGSGSGTEFTLTIS<br>SLQSEDFAVYYCQQYQNWPLTFGGGTKVEIK<br>(SEQ ID NO: 723) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 724) |
| 2G10.304 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTAACAGACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGAACTGGCCTCT<br>CACTTTCGGCGGAGGGACCAAGGTGGAGATCAAA<br>(SEQ ID NO: 725) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 726) |
| | AA | EIVMTQSPATLSVSPGERATLSCRASQSVNRHLAWYQ<br>QKPGQAPRLLIYEAATRATGIPARFSGSGSGTEFTLTIS<br>SLQSEDFAVYYCQQYQNWPLTFGGGTKVEIK<br>(SEQ ID NO: 727) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 728) |
| 2G10.323 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTCATAGACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGAACTGGCCTCT<br>CACTTTCGGCGGAGGGACCAAGGTGGAGATCAAA<br>(SEQ ID NO: 729) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 730) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVHRHLAWYQ<br>QKPGQAPRLLIYEAATRATGIPARFSGSGSGTEFTLTIS<br>SLQSEDFAVYYCQQYQNWPLTFGGGTKVEIK<br>(SEQ ID NO: 731) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 732) |
| 2G10.309 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTGAAAGACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGAACTGGCCTCT<br>CACTTTCGGCGGAGGGACCAAGGTGGAGATCAAA<br>(SEQ ID NO: 733) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 734) |
| | AA | EIVMTQSPATLSVSPGERATLSCRASQSVERHLAWYQ<br>QKPGQAPRLLIYEAATRATGIPARFSGSGSGTEFTLTIS<br>SLQSEDFAVYYCQQYQNWPLTFGGGTKVEIK<br>(SEQ ID NO: 735) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 736) |
| 2G10.316 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTTTCAGACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGAACTGGCCTCT<br>CACTTTCGGCGGAGGGACCAAGGTGGAGATCAAA<br>(SEQ ID NO: 737) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 738) |
| | AA | EIVMTQSPATLSVSPGERATLSCRASQSVFRHLAWYQ<br>QKPGQAPRLLIYEAATRATGIPARFSGSGSGTEFTLTIS<br>SLQSEDFAVYYCQQYQNWPLTFGGGTKVEIK<br>(SEQ ID NO: 739) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 740) |
| 2G10.604 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTAACAGACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGGTCAGTGGCAGTGGGTCTGGGACAGAGTTCA<br>CTCTCACCATCAGCAGCCTGCAGTCTGAAGATTTTG<br>CAGTTTATTACTGTCAGCAGTATCAGAACTGGCCTC<br>TCACTTTCGGCGGAGGGACCAAGGTGGAGATCAAA<br>(SEQ ID NO: 741) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 742) |
| | AA | EIVMTQSPATLSVSPGERATLSCRASQSVNRHLAWYQ<br>QKPGQAPRLLIYEAATRATGIPARVSGSGSGTEFTLTIS<br>SLQSEDFAVYYCQQYQNWPLTFGGGTKVEIK<br>(SEQ ID NO: 743) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 744) |
| 2G10.609 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTGAAAGACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGGTCAGTGGCAGTGGGTCTGGGACAGAGTTCA<br>CTCTCACCATCAGCAGCCTGCAGTCTGAAGATTTTG<br>CAGTTTATTACTGTCAGCAGTATCAGAACTGGCCTC<br>TCACTTTCGGCGGAGGGACCAAGGTGGAGATCAAA<br>(SEQ ID NO: 745) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 746) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVERHLAWYQ<br>QKPGQAPRLLIYEAATRATGIPARVSGSGSGTEFTLTIS<br>SLQSEDFAVYYCQQYQNWPLTFGGGTKVEIK<br>(SEQ ID NO: 747) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 748) |
| 2G10.603 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTGATAGACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGGTCAGTGGCAGTGGGTCTGGGACAGAGTTCA<br>CTCTCACCATCAGCAGCCTGCAGTCTGAAGATTTTG<br>CAGTTTATTACTGTCAGCAGTATCAGAACTGGCCTC<br>TCACTTTCGGCGGAGGGACCAAGGTGGAGATCAAA<br>(SEQ ID NO: 749) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 750) |
| | AA | EIVMTQSPATLSVSPGERATLSCRASQSVDRHLAWYQ<br>QKPGQAPRLLIYEAATRATGIPARVSGSGSGTEFTLTIS<br>SLQSEDFAVYYCQQYQNWPLTFGGGTKVEIK<br>(SEQ ID NO: 751) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 752) |
| 2G10.318 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTCTGAGTCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACAACTGGCCTCT<br>CACTTTCGGCGGAGGGACCAAGGTGGAGATCAAA<br>(SEQ ID NO: 753) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 754) |
| | AA | EIVMTQSPATLSVSPGERATLSCRASQSVLSHLAWYQ<br>QKPGQAPRLLIYEAATRATGIPARFSGSGSGTEFTLTIS<br>SLQSEDFAVYYCQQYNNWPLTFGGGTKVEIK<br>(SEQ ID NO: 755) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 756) |
| 2G10.324 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTCTGAGTCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGAACTGGCCTCT<br>CACTTTCGGCGGAGGGACCAAGGTGGAGATCAAA<br>(SEQ ID NO: 757) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 758) |
| | AA | EIVMTQSPATLSVSPGERATLSCRASQSVLSHLAWYQ<br>QKPGQAPRLLIYEAATRATGIPARFSGSGSGTEFTLTIS<br>SLQSEDFAVYYCQQYQNWPLTFGGGTKVEIK<br>(SEQ ID NO: 759) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 760) |
| 2G10.322 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTATGAGTCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGAACTGGCCTCT<br>CACTTTCGGCGGAGGGACCAAGGTGGAGATCAAA<br>(SEQ ID NO: 761) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 762) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVMSHLAWYQ<br>QKPGQAPRLLIYEAATRATGIPARFSGSGSGTEFTLTIS<br>SLQSEDFAVYYCQQYQNWPLTFGGGTKVEIK<br>(SEQ ID NO: 763) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 764) |
| 2G10.315 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTCTGACGCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGAACTGGCCTCT<br>CACTTTCGGCGGAGGGACCAAGGTGGAGATCAAA<br>(SEQ ID NO: 765) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 766) |
| | AA | EIVMTQSPATLSVSPGERATLSCRASQSVLTHLAWYQ<br>QKPGQAPRLLIYEAATRATGIPARFSGSGSGTEFTLTIS<br>SLQSEDFAVYYCQQYQNWPLTFGGGTKVEIK<br>(SEQ ID NO: 767) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 768) |
| 2G10.331 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTGATCTGCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGAACTGGCCTCT<br>CACTTTCGGCGGAGGGACCAAGGTGGAGATCAAA<br>(SEQ ID NO: 769) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 770) |
| | AA | EIVMTQSPATLSVSPGERATLSCRASQSVDLHLAWYQ<br>QKPGQAPRLLIYEAATRATGIPARFSGSGSGTEFTLTIS<br>SLQSEDFAVYYCQQYQNWPLTFGGGTKVEIK<br>(SEQ ID NO: 771) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 772) |
| 2G10.320 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTAGCGAACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGAACTGGCCTCT<br>CACTTTCGGCGGAGGGACCAAGGTGGAGATCAAA<br>(SEQ ID NO: 773) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATCTGGCGATTTTTGGAGTGATTCC<br>CGACTACTGGGGCCAGGGAACCCTGGTCACCGTGTC<br>TAGT<br>(SEQ ID NO: 774) |
| | AA | EIVMTQSPATLSVSPGERATLSCRASQSVSEHLAWYQ<br>QKPGQAPRLLIYEAATRATGIPARFSGSGSGTEFTLTIS<br>SLQSEDFAVYYCQQYQNWPLTFGGGTKVEIK<br>(SEQ ID NO: 775) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVIPDY<br>WGQGTLVTVSS<br>(SEQ ID NO: 776) |
| 2G10.328 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTAGCGAACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGAACTGGCCTCT<br>CACTTTCGGCGGAGGGACCAAGGTGGAGATCAAA<br>(SEQ ID NO: 777) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 778) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVSEHLAWYQ QKPGQAPRLLIYEAATRATGIPARFSGSGSGTEFTLTIS SLQSEDFAVYYCQQYQNWPLTFGGGTKVEIK (SEQ ID NO: 779) | QVQLVESGGGVVQPGRSLRLSCAASGFTFSNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 780) |
| 2G10.333 | NA | GAAATAGTGATGACGCAGTCTCCAGCCACCCTGTCT GTGTCTCCAGGGGAAAGAGCCACCCTCTCCTGCAGG GCCAGTCAGAGTGTTAGCCGGCACTTAGCCTGGTAC CAGCAGAAACCTGGCCAGGCTCCCAGGCTCCTCATC TACGAAGCAGCCACCAGGGCCACTGGTATCCCAGC CAGGTTCAGTGGCAGTGGGTCTGGGACAGAGTTCAC TCTCACCATCAGCAGCCTGCAGTCTGAAGATTTTGC AGTTTATTACTGTCAGCAGTATCAGCACTGGCCTCT CACTTTCGGCGGAGGGACCAAGGTGGAGATCAAA (SEQ ID NO: 781) | CAGGTGCAGCTGGTGGAGTCTGGGGGAGGCGTGGT CCAGCCTGGGAGGTCCCTGAGACTCTCCTGTGCAGC ATCTGGATTCACCTTCAGTAACTATGGCATGCACTG GGTCCGCCAGGCTCCAGGCGAGGGGCTGGAGTGGG TGGCAGCTATATGGTTTGATGCAAGTGATAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATTTGGCGATTTTTGGAGTGGTCCC CGACTACTGGGGCCAGGGAACCCTGGTCACCGTGTC TAGT (SEQ ID NO: 782) |
| | AA | EIVMTQSPATLSVSPGERATLSCRASQSVSRHLAWYQ QKPGQAPRLLIYEAATRATGIPARFSGSGSGTEFTLTIS SLQSEDFAVYYCQQYQHWPLTFGGGTKVEIK (SEQ ID NO: 783) | QVQLVESGGGVVQPGRSLRLSCAASGFTFSNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 784) |
| 2G10.301 | NA | GAAATAGTGATGACGCAGTCTCCAGCCACCCTGTCT GTGTCTCCAGGGGAAAGAGCCACCCTCTCCTGCAGG GCCAGTCAGAGTGTTTTCAGCCACTTAGCCTGGTAC CAGCAGAAACCTGGCCAGGCTCCCAGGCTCCTCATC TACGAAGCAGCCACCAGGGCCACTGGTATCCCAGC CAGGTTCAGTGGCAGTGGGTCTGGGACAGAGTTCAC TCTCACCATCAGCAGCCTGCAGTCTGAAGATTTTGC AGTTTATTACTGTCAGCAGTATCAGAACTGGCCTCT CACTTTCGGCGGAGGGACCAAGGTGGAGATCAAA (SEQ ID NO: 785) | CAGGTGCAGCTGGTGGAGTCTGGGGGAGGCGTGGT CCAGCCTGGGAGGTCCCTGAGACTCTCCTGTGCAGC ATCTGGATTCACCTTCCAGAACTATGGCATGCACTG GGTCCGCCAGGCTCCAGGCGAGGGGCTGGAGTGGG TGGCAGCTATATGGTTTGATGCGTCTGACAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATCTTGCGATTTTTGGAGTGGTCCC CGACTACTGGGGCCAGGGAACCCTGGTCACCGTGTC TAGT (SEQ ID NO: 786) |
| | AA | EIVMTQSPATLSVSPGERATLSCRASQSVFSHLAWYQQ KPGQAPRLLIYEAATRATGIPARFSGSGSGTEFTLTISSL QSEDFAVYYCQQYQNWPLTFGGGTKVEIK (SEQ ID NO: 787) | QVQLVESGGGVVQPGRSLRLSCAASGFTFQNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 788) |
| 2G10.601 | NA | GAAATAGTGATGACGCAGTCTCCAGCCACCCTGTCT GTGTCTCCAGGGGAAAGAGCCACCCTCTCCTGCAGG GCCAGTCAGAGTGTTTTCAGCCACTTAGCCTGGTAC CAGCAGAAACCTGGCCAGGCTCCCAGGCTCCTCATC TACGAAGCAGCCACCAGGGCCACTGGTATCCCAGC CAGGGTCAGTGGCAGTGGGTCTGGGACAGAGTTCA CTCTCACCATCAGCAGCCTGCAGTCTGAAGATTTTG CAGTTTATTACTGTCAGCAGTATCAGAACTGGCCTC TCACTTTCGGCGGAGGGACCAAGGTGGAGATCAAA (SEQ ID NO: 789) | CAGGTGCAGCTGGTGGAGTCTGGGGGAGGCGTGGT CCAGCCTGGGAGGTCCCTGAGACTCTCCTGTGCAGC ATCTGGATTCACCTTCCAGAACTATGGCATGCACTG GGTCCGCCAGGCTCCAGGCGAGGGGCTGGAGTGGG TGGCAGCTATATGGTTTGATGCGTCTGACAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATCTTGCGATTTTTGGAGTGGTCCC CGACTACTGGGGCCAGGGAACCCTGGTCACCGTGTC TAGT (SEQ ID NO: 790) |
| | AA | EIVMTQSPATLSVSPGERATLSCRASQSVFSHLAWYQQ KPGQAPRLLIYEAATRATGIPARVSGSGSGTEFTLTISS LQSEDFAVYYCQQYQNWPLTFGGGTKVEIK (SEQ ID NO: 791) | QVQLVESGGGVVQPGRSLRLSCAASGFTFQNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 792) |
| 2G10.326 | NA | GAAATAGTGATGACGCAGTCTCCAGCCACCCTGTCT GTGTCTCCAGGGGAAAGAGCCACCCTCTCCTGCAGG GCCAGTCAGAGTGTTCTGAGTCACTTAGCCTGGTAC CAGCAGAAACCTGGCCAGGCTCCCAGGCTCCTCATC TACGAAGCAGCCACCAGGGCCACTGGTATCCCAGC CAGGTTCAGTGGCAGTGGGTCTGGGACAGAGTTCAC TCTCACCATCAGCAGCCTGCAGTCTGAAGATTTTGC AGTTTATTACTGTCAGCAGTATCAGCAGTGGCCTCT CACTTTCGGCGGAGGGACCAAGGTGGAGATCAAA (SEQ ID NO: 793) | CAGGTGCAGCTGGTGGAGTCTGGGGGAGGCGTGGT CCAGCCTGGGAGGTCCCTGAGACTCTCCTGTGCAGC ATCTGGATTCACCTTCCAGAACTATGGCATGCACTG GGTCCGCCAGGCTCCAGGCGAGGGGCTGGAGTGGG TGGCAGCTATATGGTTTGATGCGTCTGACAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATCTTGCGATTTTTGGAGTGGTCCC CGACTACTGGGGCCAGGGAACCCTGGTCACCGTGTC TAGT (SEQ ID NO: 793) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVLSHLAWYQ QKPGQAPRLLIYEAATRATGIPARFSGSGSGTEFTLTIS SLQSEDFAVYYCQQYQQWPLTFGGGTKVEIK (SEQ ID NO: 75) | QVQLVESGGGVVQPGRSLRLSCAASGFTFQNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 796) |
| 2G10.308 | NA | GAAATAGTGATGACGCAGTCTCCAGCCACCCTGTCT GTGTCTCCAGGGGAAAGAGCCACCCTCTCCTGCAGG GCCAGTCAGAGTGTTTTCAGCCACTTAGCCTGGTAC CAGCAGAAACCTGGCCAGGCTCCCAGGCTCCTCATC TACGAAGCAGCCACCAGGGCCACTGGTATCCCAGC CAGGTTCAGTGGCAGTGGGTCTGGGACAGAGTTCAC TCTCACCATCAGCAGCCTGCAGTCTGAAGATTTTGC AGTTTATTACTGTCAGCAGTATCAGCAGTGGCCTCT CACTTTCGGCGGAGGGACCAAGGTGGAGATCAAA (SEQ ID NO: 797) | CAGGTGCAGCTGGTGGAGTCTGGGGGAGGCGTGGT CCAGCCTGGGAGGTCCCTGAGACTCTCCTGTGCAGC ATCTGGATTCACCTTCAGTAACTATGGCATGCACTG GGTCCGCCAGGCTCCAGGCGAGGGGCTGGAGTGGG TGGCAGCTATATGGTTTGATGCAAGTGATAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATTTGGCGATTTTTGGAGTGGTCCC CGACTACTGGGGCCAGGGAACCCTGGTCACCGTGTC TAGT (SEQ ID NO: 798) |
| | AA | EIVMTQSPATLSVSPGERATLSCRASQSVFSHLAWYQQ KPGQAPRLLIYEAATRATGIPARFSGSGSGTEFTLTISSL QSEDFAVYYCQQYQQWPLTFGGGTKVEIK (SEQ ID NO: 799) | QVQLVESGGGVVQPGRSLRLSCAASGFTFSNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 800) |
| 2G10.608 | NA | GAAATAGTGATGACGCAGTCTCCAGCCACCCTGTCT GTGTCTCCAGGGGAAAGAGCCACCCTCTCCTGCAGG GCCAGTCAGAGTGTTTTCAGCCACTTAGCCTGGTAC CAGCAGAAACCTGGCCAGGCTCCCAGGCTCCTCATC TACGAAGCAGCCACCAGGGCCACTGGTATCCCAGC CAGGGTCAGTGGCAGTGGGTCTGGGACAGAGTTCA CTCTCACCATCAGCAGCCTGCAGTCTGAAGATTTTG CAGTTTATTACTGTCAGCAGTATCAGCAGTGGCCTC TCACTTTCGGCGGAGGGACCAAGGTGGAGATCAAA (SEQ ID NO: 801) | CAGGTGCAGCTGGTGGAGTCTGGGGGAGGCGTGGT CCAGCCTGGGAGGTCCCTGAGACTCTCCTGTGCAGC ATCTGGATTCACCTTCAGTAACTATGGCATGCACTG GGTCCGCCAGGCTCCAGGCGAGGGGCTGGAGTGGG TGGCAGCTATATGGTTTGATGCAAGTGATAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATTTGGCGATTTTTGGAGTGGTCCC CGACTACTGGGGCCAGGGAACCCTGGTCACCGTGTC TAGT (SEQ ID NO: 802) |
| | AA | EIVMTQSPATLSVSPGERATLSCRASQSVFSHLAWYQQ KPGQAPRLLIYEAATRATGIPARVSGSGSGTEFTLTISS LQSEDFAVYYCQQYQQWPLTFGGGTKVEIK (SEQ ID NO: 803) | QVQLVESGGGVVQPGRSLRLSCAASGFTFSNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 804) |
| 2G10.336 | NA | GAAATAGTGATGACGCAGTCTCCAGCCACCCTGTCT GTGTCTCCAGGGGAAAGAGCCACCCTCTCCTGCAGG GCCAGTCAGAGTGTTCAGAGCCACTTAGCCTGGTAC CAGCAGAAACCTGGCCAGGCTCCCAGGCTCCTCATC TACGAAGCAGCCACCAGGGCCACTGGTATCCCAGC CAGGTTCAGTGGCAGTGGGTCTGGGACAGAGTTCAC TCTCACCATCAGCAGCCTGCAGTCTGAAGATTTTGC AGTTTATTACTGTCAGCAGTATCAGAACTGGCCTCT CACTTTCGGCGGAGGGACCAAGGTGGAGATCAAA (SEQ ID NO: 805) | CAGGTGCAGCTGGTGGAGTCTGGGGGAGGCGTGGT CCAGCCTGGGAGGTCCCTGAGACTCTCCTGTGCAGC ATCTGGATTCACCTTCAGTAACTATGGCATGCACTG GGTCCGCCAGGCTCCAGGCGAGGGGCTGGAGTGGG TGGCAGCTATATGGTTTGATGCAAGTGATAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATATTGCGATTTTTGGAGTGGTCCC CGACTACTGGGGCCAGGGAACCCTGGTCACCGTGTC TAGT (SEQ ID NO: 806) |
| | AA | EIVMTQSPATLSVSPGERATLSCRASQSVQSHLAWYQ QKPGQAPRLLIYEAATRATGIPARFSGSGSGTEFTLTIS SLQSEDFAVYYCQQYQNWPLTFGGGTKVEIK (SEQ ID NO: 807) | QVQLVESGGGVVQPGRSLRLSCAASGFTFSNYGMHW VRQAPGEGLEWVAAIWFDASDKYYADAVKGRFTISR DNSKNTLYLQMNSLRAEDTAVYYCARDIAIFGVVPDY WGQGTLVTVSS (SEQ ID NO: 808) |
| 2G10.344 | NA | GAAATAGTGATGACGCAGTCTCCAGCCACCCTGTCT GTGTCTCCAGGGGAAAGAGCCACCCTCTCCTGCAGG GCCAGTCAGAGTGTTAGTAGCCACTTAGCCTGGTAC CAGCAGAAACCTGGCCAGGCTCCCAGGCTCCTCATC TACGAAGCAGCCACCAGGGCCACTGGTATCCCAGC CAGGTTCAGTGGCAGTGGGTCTGGGACAGAGTTCAC TCTCACCATCAGCAGCCTGCAGTCTGAAGATTTTGC AGTTTATTACTGTCAGCAGTATCAGCAGTGGCCTCT CACTTTCGGCGGAGGGACCAAGGTGGAGATCAAA (SEQ ID NO: 809) | CAGGTGCAGCTGGTGGAGTCTGGGGGAGGCGTGGT CCAGCCTGGGAGGTCCCTGAGACTCTCCTGTGCAGC ATCTGGATTCACCTTCAGTAACTATGGCATGCACTG GGTCCGCCAGGCTCCAGGCGAGGGGCTGGAGTGGG TGGCAGCTATATGGTTTGATGCAAGTGATAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATATTGCGATTTTTGGAGTGGTCCC CGACTACTGGGGCCAGGGAACCCTGGTCACCGTGTC TAGT (SEQ ID NO: 810) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVSSHLAWYQQ KPGQAPRLLIYEAATRATGIPARFSGSGSGTEFTLTISSL QSEDFAVYYCQQYQQWPLTFGGGTKVEIK (SEQ ID NO: 811) | QVQLVESGGGVVQPGRSLRLSCAASGFTFSNYGMHW VRQAPGEGLEWVAAIWFDASDKYYADAVKGRFTISR DNSKNTLYLQMNSLRAEDTAVYYCARDIAIFGVVPDY WGQGTLVTVSS (SEQ ID NO: 812) |
| 2G10.310 | NA | GAAATAGTGATGACGCAGTCTCCAGCCACCCTGTCT GTGTCTCCAGGGGAAAGAGCCACCCTCTCCTGCAGG GCCAGTCAGAGTGTTTTCACGCACTTAGCCTGGTAC CAGCAGAAACCTGGCCAGGCTCCCAGGCTCCTCATC TACGAAGCAGCCACCAGGGCCACTGGTATCCCAGC CAGGTTCAGTGGCAGTGGGTCTGGGACAGAGTTCAC TCTCACCATCAGCAGCCTGCAGTCTGAAGATTTTGC AGTTTATTACTGTCAGCAGTATAACAACTGGCCTCT CACTTTCGGCGGAGGGACCAAGGTGGAGATCAAA (SEQ ID NO: 813) | CAGGTGCAGCTGGTGGAGTCTGGGGGAGGCGTGGT CCAGCCTGGGAGGTCCCTGAGACTCTCCTGTGCAGC ATCTGGATTCACCTTCAGTAACTATGGCATGCACTG GGTCCGCCAGGCTCCAGGCGAGGGGCTGGAGTGGG TGGCAGCTATATGGTTTGATGCAAGTGATAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATTTGGCGATTTTTGGAGTGGTCCC CGACTACTGGGGCCAGGGAACCCTGGTCACCGTGTC TAGT (SEQ ID NO: 814) |
| | AA | EIVMTQSPATLSVSPGERATLSCRASQSVFTHLAWYQ QKPGQAPRLLIYEAATRATGIPARFSGSGSGTEFTLTIS SLQSEDFAVYYCQQYNNWPLTFGGGTKVEIK (SEQ ID NO: 815) | QVQLVESGGGVVQPGRSLRLSCAASGFTFSNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 816) |
| 2G10.610 | NA | GAAATAGTGATGACGCAGTCTCCAGCCACCCTGTCT GTGTCTCCAGGGGAAAGAGCCACCCTCTCCTGCAGG GCCAGTCAGAGTGTTTTCACGCACTTAGCCTGGTAC CAGCAGAAACCTGGCCAGGCTCCCAGGCTCCTCATC TACGAAGCAGCCACCAGGGCCACTGGTATCCCAGC CAGGGTCAGTGGCAGTGGGTCTGGGACAGAGTTCA CTCTCACCATCAGCAGCCTGCAGTCTGAAGATTTTG CAGTTTATTACTGTCAGCAGTATAACAACTGGCCTC TCACTTTCGGCGGAGGGACCAAGGTGGAGATCAAA (SEQ ID NO: 817) | CAGGTGCAGCTGGTGGAGTCTGGGGGAGGCGTGGT CCAGCCTGGGAGGTCCCTGAGACTCTCCTGTGCAGC ATCTGGATTCACCTTCAGTAACTATGGCATGCACTG GGTCCGCCAGGCTCCAGGCGAGGGGCTGGAGTGGG TGGCAGCTATATGGTTTGATGCAAGTGATAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATTTGGCGATTTTTGGAGTGGTCCC CGACTACTGGGGCCAGGGAACCCTGGTCACCGTGTC TAGT (SEQ ID NO: 818) |
| | AA | EIVMTQSPATLSVSPGERATLSCRASQSVFTHLAWYQ QKPGQAPRLLIYEAATRATGIPARVSGSGSGTEFTLTIS SLQSEDFAVYYCQQYNNWPLTFGGGTKVEIK (SEQ ID NO: 819) | QVQLVESGGGVVQPGRSLRLSCAASGFTFSNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 820) |
| 2G10.312 | NA | GAAATAGTGATGACGCAGTCTCCAGCCACCCTGTCT GTGTCTCCAGGGGAAAGAGCCACCCTCTCCTGCAGG GCCAGTCAGAGTGTTTTTGAACACTTAGCCTGGTAC CAGCAGAAACCTGGCCAGGCTCCCAGGCTCCTCATC TACGAAGCAGCCACCAGGGCCACTGGTATCCCAGC CAGGTTCAGTGGCAGTGGGTCTGGGACAGAGTTCAC TCTCACCATCAGCAGCCTGCAGTCTGAAGATTTTGC AGTTTATTACTGTCAGCAGTATAACAACTGGCCTCT CACTTTCGGCGGAGGGACCAAGGTGGAGATCAAA (SEQ ID NO: 821) | CAGGTGCAGCTGGTGGAGTCTGGGGGAGGCGTGGT CCAGCCTGGGAGGTCCCTGAGACTCTCCTGTGCAGC ATCTGGATTCACCTTCAGTAACTATGGCATGCACTG GGTCCGCCAGGCTCCAGGCGAGGGGCTGGAGTGGG TGGCAGCTATATGGTTTGATGCAAGTGATAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATTTGGCGATTTTTGGAGTGGTCCC CGACTACTGGGGCCAGGGAACCCTGGTCACCGTGTC TAGT (SEQ ID NO: 822) |
| | AA | EIVMTQSPATLSVSPGERATLSCRASQSVFEHLAWYQ QKPGQAPRLLIYEAATRATGIPARFSGSGSGTEFTLTIS SLQSEDFAVYYCQQYNNWPLTFGGGTKVEIK (SEQ ID NO: 823) | QVQLVESGGGVVQPGRSLRLSCAASGFTFSNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 824) |
| 2G10.329 | NA | GAAATAGTGATGACGCAGTCTCCAGCCACCCTGTCT GTGTCTCCAGGGGAAAGAGCCACCCTCTCCTGCAGG GCCAGTCAGAGTGTTGAACAGCACTTAGCCTGGTAC CAGCAGAAACCTGGCCAGGCTCCCAGGCTCCTCATC TACGAAGCAGCCACCAGGGCCACTGGTATCCCAGC CAGGTTCAGTGGCAGTGGGTCTGGGACAGAGTTCAC TCTCACCATCAGCAGCCTGCAGTCTGAAGATTTTGC AGTTTATTACTGTCAGCAGTATAACAACTGGCCTCT CACTTTCGGCGGAGGGACCAAGGTGGAGATCAAA (SEQ ID NO: 825) | CAGGTGCAGCTGGTGGAGTCTGGGGGAGGCGTGGT CCAGCCTGGGAGGTCCCTGAGACTCTCCTGTGCAGC ATCTGGATTCACCTTCAGTAACTATGGCATGCACTG GGTCCGCCAGGCTCCAGGCGAGGGGCTGGAGTGGG TGGCAGCTATATGGTTTGATGCAAGTGATAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATTTGGCGATTTTTGGAGTGGTCCC CGACTACTGGGGCCAGGGAACCCTGGTCACCGTGTC TAGT (SEQ ID NO: 826) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVEQHLAWYQ<br>QKPGQAPRLLIYEAATRATGIPARFSGSGSGTEFTLTIS<br>SLQSEDFAVYYCQQYNNWPLTFGGGTKVEIK<br>(SEQ ID NO: 827) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 828) |
| 2G10.327 | NA | GAAATAGTGATGACGCAGTCTCCGGCCACCCTGTCT<br>GTGTCTCCAGGGGAAAGAGCCACCCTCTCCTGCAGG<br>GCCAGTCAGAGTGTTCATAGCCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACCAGTGGCCTCT<br>CACTTTCGGCGGAGGGACCAAGGTGGAGATCAAA<br>(SEQ ID NO: 829) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 830) |
| | AA | EIVMTQSPATLSVSPGERATLSCRASQSVHSHLAWYQ<br>QKPGQAPRLLIYEAATRATGIPARFSGSGSGTEFTLTIS<br>SLQSEDFAVYYCQQYNQWPLTFGGGTKVEIK<br>(SEQ ID NO: 831) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 832) |
| 2G10.338 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTCATCATCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACCAGTGGCCTCT<br>CACTTTCGGCGGAGGGACCAAGGTGGAGATCAAA<br>(SEQ ID NO: 833) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 834) |
| | AA | EIVMTQSPATLSVSPGERATLSCRASQSVHHHLAWYQ<br>QKPGQAPRLLIYEAATRATGIPARFSGSGSGTEFTLTIS<br>SLQSEDFAVYYCQQYNQWPLTFGGGTKVEIK<br>(SEQ ID NO: 835) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 836) |
| 2G10.314 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTCATAGCCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACAACTGGCCTCT<br>CACTTTCGGCGGAGGGACCAAGGTGGAGATCAAA<br>(SEQ ID NO: 837) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 838) |
| | AA | EIVMTQSPATLSVSPGERATLSCRASQSVHSHLAWYQ<br>QKPGQAPRLLIYEAATRATGIPARFSGSGSGTEFTLTIS<br>SLQSEDFAVYYCQQYNNWPLTFGGGTKVEIK<br>(SEQ ID NO: 839) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 840) |
| 2G10.337 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTGATGTCAACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACCAGTGGCCTCT<br>CACTTTCGGCGGAGGGACCAAGGTGGAGATCAAA<br>(SEQ ID NO: 841) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 842) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVDVNLAWYQ<br>QKPGQAPRLLIYEAATRATGIPARFSGSGSGTEFTLTIS<br>SLQSEDFAVYYCQQYNQWPLTFGGGTKVEIK<br>(SEQ ID NO: 834) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 844) |
| 2G10.341 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTGATGTCCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACCAGTGGCCTCT<br>CACTTTCGGCGGAGGGACCAAGGTGGAGATCAAA<br>(SEQ ID NO: 845) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 846) |
| | AA | EIVMTQSPATLSVSPGERATLSCRASQSVDVHLAWYQ<br>QKPGQAPRLLIYEAATRATGIPARFSGSGSGTEFTLTIS<br>SLQSEDFAVYYCQQYNQWPLTFGGGTKVEIK<br>(SEQ ID NO: 847) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 848) |
| 2G10.302 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTTTTGAACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACAACTGGCCTCT<br>CACTTTCGGCGGAGGGACCAAGGTGGAGATCAAA<br>(SEQ ID NO: 849) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATATTGCGATTTTTGGAGTGTTTCC<br>CGACTACTGGGGCCAGGGAACCCTGGTCACCGTGTC<br>TAGT<br>(SEQ ID NO: 850) |
| | AA | EIVMTQSPATLSVSPGERATLSCRASQSVFEHLAWYQ<br>QKPGQAPRLLIYEAATRATGIPARFSGSGSGTEFTLTIS<br>SLQSEDFAVYYCQQYNNWPLTFGGGTKVEIK<br>(SEQ ID NO: 851) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDIAIFGVFPDY<br>WGQGTLVTVSS<br>(SEQ ID NO: 852) |
| 2G10.602 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTTTTGAACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGGTCAGTGGCAGTGGGTCTGGGACAGAGTTCA<br>CTCTCACCATCAGCAGCCTGCAGTCTGAAGATTTTG<br>CAGTTTATTACTGTCAGCAGTATAACAACTGGCCTC<br>TCACTTTCGGCGGAGGGACCAAGGTGGAGATCAAA<br>(SEQ ID NO: 853) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATATTGCGATTTTTGGAGTGTTTCC<br>CGACTACTGGGGCCAGGGAACCCTGGTCACCGTGTC<br>TAGT<br>(SEQ ID NO: 854) |
| | AA | EIVMTQSPATLSVSPGERATLSCRASQSVFEHLAWYQ<br>QKPGQAPRLLIYEAATRATGIPARVSGSGSGTEFTLTIS<br>SLQSEDFAVYYCQQYNNWPLTFGGGTKVEIK<br>(SEQ ID NO: 855) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDIAIFGVFPDY<br>WGQGTLVTVSS<br>(SEQ ID NO: 856) |
| 2G10.325 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTTTCGAACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACCAGTGGCCTCT<br>CACTTTCGGCGGAGGGACCAAGGTGGAGATCAAA<br>(SEQ ID NO: 857) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATATTGCGATTTTTGGAGTGGTCCC<br>CGACTACTGGGGCCAGGGAACCCTGGTCACCGTGTC<br>TAGT<br>(SEQ ID NO: 858) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVFEHLAWYQ<br>QKPGQAPRLLIYEAATRATGIPARFSGSGSGTEFTLTIS<br>SLQSEDFAVYYCQQYNQWPLTFGGGTKVEIK<br>(SEQ ID NO: 859) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDIAIFGVVPDY<br>WGQGTLVTVSS<br>(SEQ ID NO: 860) |
| 2G10.343 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTCTGGAACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACAACTGGCCTCT<br>CACTTTCGGCGGAGGGACCAAGGTGGAGATCAAA<br>(SEQ ID NO: 861) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATATTGCGATTTTTGGAGTGGTCCC<br>CGACTACTGGGGCCAGGGAACCCTGGTCACCGTGTC<br>TAGT<br>(SEQ ID NO: 862) |
| | AA | EIVMTQSPATLSVSPGERATLSCRASQSVLEHLAWYQ<br>QKPGQAPRLLIYEAATRATGIPARFSGSGSGTEFTLTIS<br>SLQSEDFAVYYCQQYNNWPLTFGGGTKVEIK<br>(SEQ ID NO: 863) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDIAIFGVVPDY<br>WGQGTLVTVSS<br>(SEQ ID NO: 864) |
| 2G10.313 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTGATAGACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACCAGTGGCCTCT<br>CACTTTCGGCGGAGGGACCAAGGTGGAGATCAAA<br>(SEQ ID NO: 865) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATATTGCGATTTTTGGAGTGTTTCC<br>CGACTACTGGGGCCAGGGAACCCTGGTCACCGTGTC<br>TAGT<br>(SEQ ID NO: 866) |
| | AA | EIVMTQSPATLSVSPGERATLSCRASQSVDRHLAWYQ<br>QKPGQAPRLLIYEAATRATGIPARFSGSGSGTEFTLTIS<br>SLQSEDFAVYYCQQYNQWPLTFGGGTKVEIK<br>(SEQ ID NO: 867) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDIAIFGVFPDY<br>WGQGTLVTVSS<br>(SEQ ID NO: 868) |
| 2G10.317 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTAACCGGCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGCAGTGGCCTCT<br>CACTTTCGGCGGAGGGACCAAGGTGGAGATCAAA<br>(SEQ ID NO: 869) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATATTGCGATTTTTGGAGTGTTTCC<br>CGACTACTGGGGCCAGGGAACCCTGGTCACCGTGTC<br>TAGT<br>(SEQ ID NO: 870) |
| | AA | EIVMTQSPATLSVSPGERATLSCRASQSVNRHLAWYQ<br>QKPGQAPRLLIYEAATRATGIPARFSGSGSGTEFTLTIS<br>SLQSEDFAVYYCQQYQQWPLTFGGGTKVEIK<br>(SEQ ID NO: 871) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDIAIFGVFPDY<br>WGQGTLVTVSS<br>(SEQ ID NO: 872) |
| 2G10.311 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTAACGTACACTTAGCCTGGTAC<br>CAGCAGAAACCTGGCCAGGCTCCCAGGCTCCTCATC<br>TACCAGGCAGCCACCAGGGCCACTGGTATCCCAGCC<br>AGGTTCAGTGGCAGTGGGTCTGGGACAGAGTTCACT<br>CTCACCATCAGCAGCCTGCAGTCTGAAGATTTTGCA<br>GTTTATTACTGTCAGCAGTATAACCAGTGGCCTCTC<br>ACTTTCGGCGGAGGGACCAAGGTGGAGATCAAA<br>(SEQ ID NO: 873) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATATTGCGATTTTTGGAGTGTTTCC<br>CGACTACTGGGGCCAGGGAACCCTGGTCACCGTGTC<br>TAGT<br>(SEQ ID NO: 874) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVNVHLAWYQ<br>QKPGQAPRLLIYQAATRATGIPARFSGSGSGTEFTLTIS<br>SLQSEDFAVYYCQQYNQWPLTFGGGTKVEIK<br>(SEQ ID NO: 875) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDIAIFGVFPDY<br>WGQGTLVTVSS<br>(SEQ ID NO: 876) |
| 2G10.306 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTCTGACGCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGAACTGGCCTCT<br>CACTTTCGGCGGAGGGACCAAGGTGGAGATCAAA<br>(SEQ ID NO: 877) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATATTGCGATTTTTGGAGTGATCCC<br>CGACTACTGGGGCCAGGGAACCCTGGTCACCGTGTC<br>TAGT<br>(SEQ ID NO: 878) |
| | AA | EIVMTQSPATLSVSPGERATLSCRASQSVLTHLAWYQ<br>QKPGQAPRLLIYEAATRATGIPARFSGSGSGTEFTLTIS<br>SLQSEDFAVYYCQQYQNWPLTFGGGTKVEIK<br>(SEQ ID NO: 879) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDIAIFGVIPDY<br>WGQGTLVTVSS<br>(SEQ ID NO: 880) |
| 2G10.606 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTCTGACGCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGGTCAGTGGCAGTGGGTCTGGGACAGAGTTCA<br>CTCTCACCATCAGCAGCCTGCAGTCTGAAGATTTTG<br>CAGTTTATTACTGTCAGCAGTATCAGAACTGGCCTC<br>TCACTTTCGGCGGAGGGACCAAGGTGGAGATCAAA<br>(SEQ ID NO: 881) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATATTGCGATTTTTGGAGTGATCCC<br>CGACTACTGGGGCCAGGGAACCCTGGTCACCGTGTC<br>TAGT<br>(SEQ ID NO: 882) |
| | AA | EIVMTQSPATLSVSPGERATLSCRASQSVLTHLAWYQ<br>QKPGQAPRLLIYEAATRATGIPARVSGSGSGTEFTLTIS<br>SLQSEDFAVYYCQQYQNWPLTFGGGTKVEIK<br>(SEQ ID NO: 883) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDIAIFGVIPDY<br>WGQGTLVTVSS<br>(SEQ ID NO: 884) |
| 2G10.347 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTAGCAGCAACTTAGCCTGGTAC<br>CAGCAGAAACCTGGCCAGGCTCCCAGGCTCCTCATC<br>TATGGTGCAGCCACCAGGGCCACTGGTATCCCAGCC<br>AGGTTCAGTGGCAGTGGGTCTGGGACAGAGTTCACT<br>CTCACCATCAGCAGCCTGCAGTCTGAAGATTTTGCA<br>GTTTATTACTGTCAGCAGTATAATAACTGGCCTCTC<br>ACTTTCGGCGGAGGGACCAAGGTGGAGATCAAA<br>(SEQ ID NO: 885) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 886) |
| | AA | EIVMTQSPATLSVSPGERATLSCRASQSVSSNLAWYQQ<br>KPGQAPRLLIYGAATRATGIPARFSGSGSGTEFTLTISS<br>LQSEDFAVYYCQQYNNWPLTFGGGTKVEIK<br>(SEQ ID NO: 887) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 888) |
| 2G10.348 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTAGCAGCAACTTAGCCTGGTAC<br>CAGCAGAAACCTGGCCAGGCTCCCAGGCTCCTCATC<br>TATGGTGCAGCCACCAGGGCCACTGGTATCCCAGCC<br>AGGTTCAGTGGCAGTGGGTCTGGGACAGAGTTCACT<br>CTCACCATCAGCAGCCTGCAGTCTGAAGATTTTGCA<br>GTTTATTACTGTCAGCAGTATAATAACTGGCCTCTC<br>ACTTTCGGCGGAGGGACCAAGGTGGAGATCAAA<br>(SEQ ID NO: 889) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATCAGGCGATTTTTGGAGTGGTCCC<br>CGATTACTGGGGCCAGGGAACCCTGGTCACCGTGTC<br>TAGT<br>(SEQ ID NO: 890) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVSSNLAWYQQ<br>KPGQAPRLLIYGAATRATGIPARFSGSGSGTEFTLTISS<br>LQSEDFAVYYCQQYNNWPLTFGGGTKVEIK<br>(SEQ ID NO: 891) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDQAIFGVVPD<br>YWGQGTLVTVSS<br>(SEQ ID NO: 892) |
| 2G10.346 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTAGCAGCAACTTAGCCTGGTAC<br>CAGCAGAAACCTGGCCAGGCTCCCAGGCTCCTCATC<br>TATGGTGCAGCCACCAGGGCCACTGGTATCCCAGCC<br>AGGTTCAGTGGCAGTGGGTCTGGGACAGAGTTCACT<br>CTCACCATCAGCAGCCTGCAGTCTGAAGATTTTGCA<br>GTTTATTACTGTCAGCAGTATAATAACTGGCCTCTC<br>ACTTTCGGCGGAGGGACCAAGGTGGAGATCAAA<br>(SEQ ID NO: 893) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATATTGCGATTTTTGGAGTGGTCCC<br>CGACTACTGGGGCCAGGGAACCCTGGTCACCGTGTC<br>TAGT<br>(SEQ ID NO: 894) |
| | AA | EIVMTQSPATLSVSPGERATLSCRASQSVSSNLAWYQQ<br>KPGQAPRLLIYGAATRATGIPARFSGSGSGTEFTLTISS<br>LQSEDFAVYYCQQYNNWPLTFGGGTKVEIK<br>(SEQ ID NO: 895) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDIAIFGVVPDY<br>WGQGTLVTVSS<br>(SEQ ID NO: 896) |
| 2G10.647 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTAGCAGCAACTTAGCCTGGTAC<br>CAGCAGAAACCTGGCCAGGCTCCCAGGCTCCTCATC<br>TATGGTGCAGCCACCAGGGCCACTGGTATCCCAGCC<br>AGGGTCAGTGGCAGTGGGTCTGGGACAGAGTTCAC<br>TCTCACCATCAGCAGCCTGCAGTCTGAAGATTTTGC<br>AGTTTATTACTGTCAGCAGTATAATAACTGGCCTCT<br>CACTTTCGGCGGAGGGACCAAGGTGGAGATCAAA<br>(SEQ ID NO: 897) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 898) |
| | AA | EIVMTQSPATLSVSPGERATLSCRASQSVSSNLAWYQQ<br>KPGQAPRLLIYGAATRATGIPARVSGSGSGTEFTLTISS<br>LQSEDFAVYYCQQYNNWPLTFGGGTKVEIK<br>(SEQ ID NO: 899) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 900) |
| 2G10.649 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTAGCAGCAACTTAGCCTGGTAC<br>CAGCAGAAACCTGGCCAGGCTCCCAGGCTCCTCATC<br>TATGAAGCAGCCACCAGGGCCACTGGTATCCCAGCC<br>AGGGTCAGTGGCAGTGGGTCTGGGACAGAGTTCAC<br>TCTCACCATCAGCAGCCTGCAGTCTGAAGATTTTGC<br>AGTTTATTACTGTCAGCAGTATAATAACTGGCCTCT<br>CACTTTCGGCGGAGGGACCAAGGTGGAGATCAAA<br>(SEQ ID NO: 901) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATCAGGCGATTTTTGGAGTGGTCCC<br>CGATTACTGGGGCCAGGGAACCCTGGTCACCGTGTC<br>TAGT<br>(SEQ ID NO: 902) |
| | AA | EIVMTQSPATLSVSPGERATLSCRASQSVSSNLAWYQQ<br>KPGQAPRLLIYEAATRATGIPARVSGSGSGTEFTLTISS<br>LQSEDFAVYYCQQYNNWPLTFGGGTKVEIK<br>(SEQ ID NO: 903) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDQAIFGVVPD<br>YWGQGTLVTVSS<br>(SEQ ID NO: 904) |
| 2G10.305 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTGATGTTAACTTAGCCTGGTAC<br>CAGCAGAAACCTGGCCAGGCTCCCAGGCTCCTCATC<br>TACAACGCAGCCACCAGGGCCACTGGTATCCCAGCC<br>AGGTTCAGTGGCAGTGGGTCTGGGACAGAGTTCACT<br>CTCACCATCAGCAGCCTGCAGTCTGAAGATTTTGCA<br>GTTTATTACTGTCAGCAGTATCAGAACTGGCCTCTC<br>ACTTTCGGCGGAGGGACCAAGGTGGAGATCAAA<br>(SEQ ID NO: 905) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCAAGTGATAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATTTGGCGATTTTTGGAGTGGTCCC<br>CGACTACTGGGGCCAGGGAACCCTGGTCACCGTGTC<br>TAGT<br>(SEQ ID NO: 906) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVDVNLAWYQ QKPGQAPRLLIYNAATRATGIPARFSGSGSGTEFTLTIS SLQSEDFAVYYCQQYQNWPLTFGGGTKVEIK (SEQ ID NO: 907) | QVQLVESGGGVVQPGRSLRLSCAASGFTFSNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 908) |
| 2G10.605 | NA | GAAATAGTGATGACGCAGTCTCCAGCCACCCTGTCT GTGTCTCCAGGGGAAAGAGCCACCCTCTCCTGCAGG GCCAGTCAGAGTGTTGATGTTAACTTAGCCTGGTAC CAGCAGAAACCTGGCCAGGCTCCCAGGCTCCTCATC TACAACGCAGCCACCAGGGCCACTGGTATCCCAGCC AGGGTCAGTGGCAGTGGGTCTGGGACAGAGTTCAC TCTCACCATCAGCAGCCTGCAGTCTGAAGATTTTGC AGTTTATTACTGTCAGCAGTATCAGAACTGGCCTCT CACTTTCGGCGGAGGGACCAAGGTGGAGATCAAA (SEQ ID NO: 909) | CAGGTGCAGCTGGTGGAGTCTGGGGGAGGCGTGGT CCAGCCTGGGAGGTCCCTGAGACTCTCCTGTGCAGC ATCTGGATTCACCTTCAGTAACTATGGCATGCACTG GGTCCGCCAGGCTCCAGGCGAGGGGCTGGAGTGGG TGGCAGCTATATGGTTTGATGCAAGTGATAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATTTGGCGATTTTTGGAGTGGTCCC CGACTACTGGGGCCAGGGAACCCTGGTCACCGTGTC TAGT (SEQ ID NO: 910) |
| | AA | EIVMTQSPATLSVSPGERATLSCRASQSVDVNLAWYQ QKPGQAPRLLIYNAATRATGIPARVSGSGSGTEFTLTIS SLQSEDFAVYYCQQYQNWPLTFGGGTKVEIK (SEQ ID NO: 911) | QVQLVESGGGVVQPGRSLRLSCAASGFTFSNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 912) |
| 2G10.340 | NA | GAAATAGTGATGACGCAGTCTCCAGCCACCCTGTCT GTGTCTCCAGGGGAAAGAGCCACCCTCTCCTGCAGG GCCAGTCAGAGTGTTCATACGAACTTAGCCTGGTAC CAGCAGAAACCTGGCCAGGCTCCCAGGCTCCTCATC TACAACGCAGCCACCAGGGCCACTGGTATCCCAGCC AGGTTCAGTGGCAGTGGGTCTGGGACAGAGTTCACT CTCACCATCAGCAGCCTGCAGTCTGAAGATTTTGCA GTTTATTACTGTCAGCAGTATCAGAACTGGCCTCTC ACTTTCGGCGGAGGGACCAAGGTGGAGATCAAA (SEQ ID NO: 913) | CAGGTGCAGCTGGTGGAGTCTGGGGGAGGCGTGGT CCAGCCTGGGAGGTCCCTGAGACTCTCCTGTGCAGC ATCTGGATTCACCTTCAGTAACTATGGCATGCACTG GGTCCGCCAGGCTCCAGGCGAGGGGCTGGAGTGGG TGGCAGCTATATGGTTTGATGCAAGTGATAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATATTGCGATTTTTGGAGTGGTCCC CGACTACTGGGGCCAGGGAACCCTGGTCACCGTGTC TAGT (SEQ ID NO: 914) |
| | AA | EIVMTQSPATLSVSPGERATLSCRASQSVHTNLAWYQ QKPGQAPRLLIYNAATRATGIPARFSGSGSGTEFTLTIS SLQSEDFAVYYCQQYQNWPLTFGGGTKVEIK (SEQ ID NO: 915) | QVQLVESGGGVVQPGRSLRLSCAASGFTFSNYGMHW VRQAPGEGLEWVAAIWFDASDKYYADAVKGRFTISR DNSKNTLYLQMNSLRAEDTAVYYCARDIAIFGVVPDY WGQGTLVTVSS (SEQ ID NO: 916) |
| 2G10.334 | NA | GAAATAGTGATGACGCAGTCTCCAGCCACCCTGTCT GTGTCTCCAGGGGAAAGAGCCACCCTCTCCTGCAGG GCCAGTCAGAGTGTTAACCTGAACTTAGCCTGGTAC CAGCAGAAACCTGGCCAGGCTCCCAGGCTCCTCATC TACCAGGCAGCCACCAGGGCCACTGGTATCCCAGCC AGGTTCAGTGGCAGTGGGTCTGGGACAGAGTTCACT CTCACCATCAGCAGCCTGCAGTCTGAAGATTTTGCA GTTTATTACTGTCAGCAGTATAACCAGTGGCCTCTC ACTTTCGGCGGAGGGACCAAGGTGGAGATCAAA (SEQ ID NO: 917) | CAGGTGCAGCTGGTGGAGTCTGGGGGAGGCGTGGT CCAGCCTGGGAGGTCCCTGAGACTCTCCTGTGCAGC ATCTGGATTCACCTTCAGTAACTATGGCATGCACTG GGTCCGCCAGGCTCCAGGCGAGGGGCTGGAGTGGG TGGCAGCTATATGGTTTGATGCAAGTGATAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATTTGGCGATTTTTGGAGTGGTCCC CGACTACTGGGGCCAGGGAACCCTGGTCACCGTGTC TAGT (SEQ ID NO: 918) |
| | AA | EIVMTQSPATLSVSPGERATLSCRASQSVNLNLAWYQ QKPGQAPRLLIYQAATRATGIPARFSGSGSGTEFTLTIS SLQSEDFAVYYCQQYNQWPLTFGGGTKVEIK (SEQ ID NO: 919) | QVQLVESGGGVVQPGRSLRLSCAASGFTFSNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 920) |
| 2G10.339 | NA | GAAATAGTGATGACGCAGTCTCCAGCCACCCTGTCT GTGTCTCCAGGGGAAAGAGCCACCCTCTCCTGCAGG GCCAGTCAGAGTGTTTTCCAGAACTTAGCCTGGTAC CAGCAGAAACCTGGCCAGGCTCCCAGGCTCCTCATC TACCAGGCAGCCACCAGGGCCACTGGTATCCCAGCC AGGTTCAGTGGCAGTGGGTCTGGGACAGAGTTCACT CTCACCATCAGCAGCCTGCAGTCTGAAGATTTTGCA GTTTATTACTGTCAGCAGTATAACCAGTGGCCTCTC ACTTTCGGCGGAGGGACCAAGGTGGAGATCAAA (SEQ ID NO: 921) | CAGGTGCAGCTGGTGGAGTCTGGGGGAGGCGTGGT CCAGCCTGGGAGGTCCCTGAGACTCTCCTGTGCAGC ATCTGGATTCACCTTCAGTAACTATGGCATGCACTG GGTCCGCCAGGCTCCAGGCGAGGGGCTGGAGTGGG TGGCAGCTATATGGTTTGATGCAAGTGATAAATACT ATGCAGACGCCGTGAAGGGCCGATTCACCATCTCCA GAGACAACTCCAAGAACACGCTGTATCTGCAAATG AACAGCCTGAGAGCCGAGGACACGGCTGTGTATTA CTGTGCGAGAGATATTGCGATTTTTGGAGTGGTCCC CGACTACTGGGGCCAGGGAACCCTGGTCACCGTGTC TAGT (SEQ ID NO: 922) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVFQNLAWYQ<br>QKPGQAPRLLIYQAATRATGIPARFSGSGSGTEFTLTIS<br>SLQSEDFAVYYCQQYNQWPLTFGGGTKVEIK<br>(SEQ ID NO: 923) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDIAIFGVVPDY<br>WGQGTLVTVSS<br>(SEQ ID NO: 924) |
| 2G10.307 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTGATAGACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACCAGTGGCCTCT<br>CACTTTCGGCGGAGGGACCAAGGTGGAGATCAAA<br>(SEQ ID NO: 925) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCCAGAACTATGGCATGCACTG<br>GGTCCGCCAGGCTCCAGGCGAGGGGCTGGAGTGGG<br>TGGCAGCTATATGGTTTGATGCGTACGGTAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATCAGACGATTTTTGGAGTGGTCCC<br>CGACTACTGGGGCCAGGGAACCCTGGTCACCGTGTC<br>TAGT<br>(SEQ ID NO: 926) |
| | AA | EIVMTQSPATLSVSPGERATLSCRASQSVDRHLAWYQ<br>QKPGQAPRLLIYEAATRATGIPARFSGSGSGTEFTLTIS<br>SLQSEDFAVYYCQQYNQWPLTFGGGTKVEIK<br>(SEQ ID NO: 927) | QVQLVESGGGVVQPGRSLRLSCAASGFTFQNYGMHW<br>VRQAPGEGLEWVAAIWFDAYGKYYADAVKGRFTISR<br>DNSKNTLYLQMNSLRAEDTAVYYCARDQTIFGVVPD<br>YWGQGTLVTVSS<br>(SEQ ID NO: 928) |
| 2G10.607 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTGATAGACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGGTCAGTGGCAGTGGGTCTGGGACAGAGTTCA<br>CTCTCACCATCAGCAGCCTGCAGTCTGAAGATTTTG<br>CAGTTTATTACTGTCAGCAGTATAACCAGTGGCCTC<br>TCACTTTCGGCGGAGGGACCAAGGTGGAGATCAAA<br>(SEQ ID NO: 929) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCCAGAACTATGGCATGCACTG<br>GGTCCGCCAGGCTCCAGGCGAGGGGCTGGAGTGGG<br>TGGCAGCTATATGGTTTGATGCGTACGGTAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATCAGACGATTTTTGGAGTGGTCCC<br>CGACTACTGGGGCCAGGGAACCCTGGTCACCGTGTC<br>TAGT<br>(SEQ ID NO: 930) |
| | AA | EIVMTQSPATLSVSPGERATLSCRASQSVDRHLAWYQ<br>QKPGQAPRLLIYEAATRATGIPARVSGSGSGTEFTLTIS<br>SLQSEDFAVYYCQQYNQWPLTFGGGTKVEIK<br>(SEQ ID NO: 931) | QVQLVESGGGVVQPGRSLRLSCAASGFTFQNYGMHW<br>VRQAPGEGLEWVAAIWFDAYGKYYADAVKGRFTISR<br>DNSKNTLYLQMNSLRAEDTAVYYCARDQTIFGVVPD<br>YWGQGTLVTVSS<br>(SEQ ID NO: 932) |
| 2G10.321 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTAACCGGCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACCAGTGGCCTCT<br>CACTTTCGGCGGAGGGACCAAGGTGGAGATCAAA<br>(SEQ ID NO: 933) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCCAGAACTATGGCATGCACTG<br>GGTCCGCCAGGCTCCAGGCGAGGGGCTGGAGTGGG<br>TGGCAGCTATATGGTTTGATGCGTACGGTAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATAAGACGATTTTTGGAGTGGTCCC<br>CGACTACTGGGGCCAGGGAACCCTGGTCACCGTGTC<br>TAGT<br>(SEQ ID NO: 934) |
| | AA | EIVMTQSPATLSVSPGERATLSCRASQSVNRHLAWYQ<br>QKPGQAPRLLIYEAATRATGIPARFSGSGSGTEFTLTIS<br>SLQSEDFAVYYCQQYNQWPLTFGGGTKVEIK<br>(SEQ ID NO: 935) | QVQLVESGGGVVQPGRSLRLSCAASGFTFQNYGMHW<br>VRQAPGEGLEWVAAIWFDAYGKYYADAVKGRFTISR<br>DNSKNTLYLQMNSLRAEDTAVYYCARDKTIFGVVPD<br>YWGQGTLVTVSS<br>(SEQ ID NO: 936) |
| 2G10.342 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTGAAAGACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGCAGTGGCCTCT<br>CACTTTCGGCGGAGGGACCAAGGTGGAGATCAAA<br>(SEQ ID NO: 937) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCCAGAACTATGGCATGCACTG<br>GGTCCGCCAGGCTCCAGGCGAGGGGCTGGAGTGGG<br>TGGCAGCTATATGGTTTGATGCGTACGGTAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATAAGACGATTTTTGGAGTGGTCCC<br>CGACTACTGGGGCCAGGGAACCCTGGTCACCGTGTC<br>TAGT<br>(SEQ ID NO: 938) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVERHLAWYQ<br>QKPGQAPRLLIYEAATRATGIPARFSGSGSGTEFTLTIS<br>SLQSEDFAVYYCQQYQQWPLTFGGGTKVEIK<br>(SEQ ID NO: 939) | QVQLVESGGGVVQPGRSLRLSCAASGFTFQNYGMHW<br>VRQAPGEGLEWVAAIWFDAYGKYYADAVKGRFTISR<br>DNSKNTLYLQMNSLRAEDTAVYYCARDKTIFGVVPD<br>YWGQGTLVTVSS<br>(SEQ ID NO: 940) |
| 2G10.319 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTTTCAGACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATCAGAACTGGCCTCT<br>CACTTTCGGCGGAGGGACCAAGGTGGAGATCAAA<br>(SEQ ID NO: 941) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCAGTAACTATGGCATGCACTG<br>GGTCCGCCAGGCTCCAGGCGAGGGGCTGGAGTGGG<br>TGGCAGCTATATGGTTTGATGCGTACGGTAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATAAGACGATTTTTGGAGTGGTCCC<br>CGACTACTGGGGCCAGGGAACCCTGGTCACCGTGTC<br>TAGT<br>(SEQ ID NO: 942) |
| | AA | EIVMTQSPATLSVSPGERATLSCRASQSVFRHLAWYQ<br>QKPGQAPRLLIYEAATRATGIPARFSGSGSGTEFTLTIS<br>SLQSEDFAVYYCQQYQNWPLTFGGGTKVEIK<br>(SEQ ID NO: 943) | QVQLVESGGGVVQPGRSLRLSCAASGFTFSNYGMHW<br>VRQAPGEGLEWVAAIWFDAYGKYYADAVKGRFTISR<br>DNSKNTLYLQMNSLRAEDTAVYYCARDKTIFGVVPD<br>YWGQGTLVTVSS<br>(SEQ ID NO: 944) |
| 2G10.332 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTCTGAGTCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACAACTGGCCTCT<br>CACTTTCGGCGGAGGGACCAAGGTGGAGATCAAA<br>(SEQ ID NO: 945) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCCAGAACTATGGCATGCACTG<br>GGTCCGCCAGGCTCCAGGCGAGGGGCTGGAGTGGG<br>TGGCAGCTATATGGTTTGATGCGTACGACAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATAAGTCGATTTTTGGAGTGGTCCC<br>CGACTACTGGGGCCAGGGAACCCTGGTCACCGTGTC<br>TAGT<br>(SEQ ID NO: 946) |
| | AA | EIVMTQSPATLSVSPGERATLSCRASQSVLSHLAWYQ<br>QKPGQAPRLLIYEAATRATGIPARFSGSGSGTEFTLTIS<br>SLQSEDFAVYYCQQYNNWPLTFGGGTKVEIK<br>(SEQ ID NO: 947) | QVQLVESGGGVVQPGRSLRLSCAASGFTFQNYGMHW<br>VRQAPGEGLEWVAAIWFDAYDKYYADAVKGRFTISR<br>DNSKNTLYLQMNSLRAEDTAVYYCARDKSIFGVVPD<br>YWGQGTLVTVSS<br>(SEQ ID NO: 948) |
| 2G10.345 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTAACAGACACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACAACTGGCCTCT<br>CACTTTCGGCGGAGGGACCAAGGTGGAGATCAAA<br>(SEQ ID NO: 949) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCCAGAACTATGGCATGCACTG<br>GGTCCGCCAGGCTCCAGGCGAGGGGCTGGAGTGGG<br>TGGCAGCTATATGGTTTGATGCGTACGACAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATAAGTCGATTTTTGGAGTGGTCCC<br>CGACTACTGGGGCCAGGGAACCCTGGTCACCGTGTC<br>TAGT<br>(SEQ ID NO: 950) |
| | AA | EIVMTQSPATLSVSPGERATLSCRASQSVNRHLAWYQ<br>QKPGQAPRLLIYEAATRATGIPARFSGSGSGTEFTLTIS<br>SLQSEDFAVYYCQQYNNWPLTFGGGTKVEIK<br>(SEQ ID NO: 951) | QVQLVESGGGVVQPGRSLRLSCAASGFTFQNYGMHW<br>VRQAPGEGLEWVAAIWFDAYDKYYADAVKGRFTISR<br>DNSKNTLYLQMNSLRAEDTAVYYCARDKSIFGVVPD<br>YWGQGTLVTVSS<br>(SEQ ID NO: 952) |
| 2G10.335 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTACCAGCCACTTAGCCTGGTAC<br>CAGCAGAAACCTGGCCAGGCTCCCAGGCTCCTCATC<br>TACGAAGCAGCCACCAGGGCCACTGGTATCCCAGC<br>CAGGTTCAGTGGCAGTGGGTCTGGGACAGAGTTCAC<br>TCTCACCATCAGCAGCCTGCAGTCTGAAGATTTTGC<br>AGTTTATTACTGTCAGCAGTATAACCAGTGGCCTCT<br>CACTTTCGGCGGAGGGACCAAGGTGGAGATCAAA<br>(SEQ ID NO: 953) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCCAGAACTATGGCATGCACTG<br>GGTCCGCCAGGCTCCAGGCGAGGGGCTGGAGTGGG<br>TGGCAGCTATATGGTTTGATGCGTACGACAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATCTCGCGATTTTTGGAGTGGTCCC<br>CGACTACTGGGGCCAGGGAACCCTGGTCACCGTGTC<br>TAGT<br>(SEQ ID NO: 954) |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVMTQSPATLSVSPGERATLSCRASQSVTSHLAWYQ<br>QKPGQAPRLLIYEAATRATGIPARFSGSGSGTEFTLTIS<br>SLQSEDFAVYYCQQYNQWPLTFGGGTKVEIK<br>(SEQ ID NO: 955) | QVQLVESGGGVVQPGRSLRLSCAASGFTFQNYGMHW<br>VRQAPGEGLEWVAAIWFDAYDKYYADAVKGRFTISR<br>DNSKNTLYLQMNSLRAEDTAVYYCARDLAIFGVVPD<br>YWGQGTLVTVSS<br>(SEQ ID NO: 956) |
| 2G10.330 | NA | GAAATAGTGATGACGCAGTCTCCAGCCACCCTGTCT<br>GTGTCTCCAGGGGAAAGAGCCACCCTCTCCTGCAGG<br>GCCAGTCAGAGTGTTGATCAGCACTTAGCCTGGTAC<br>CAGCAGAAACCTGGCCAGGCTCCCAGGCTCCTCATC<br>TACCAGGCAGCCACCAGGGCCACTGGTATCCCAGCC<br>AGGTTCAGTGGCAGTGGGTCTGGGACAGAGTTCACT<br>CTCACCATCAGCAGCCTGCAGTCTGAAGATTTTGCA<br>GTTTATTACTGTCAGCAGTATCAGAACTGGCCTCTC<br>ACTTTCGGCGGAGGGACCAAGGTGGAGATCAAA<br>(SEQ ID NO: 957) | CAGGTGCAGCTGGTGGAGTCTGGGGGAGGCGTGGT<br>CCAGCCTGGGAGGTCCCTGAGACTCTCCTGTGCAGC<br>ATCTGGATTCACCTTCCAGAACTATGGCATGCACTG<br>GGTCCGCCAGGCTCCAGGCGAGGGGCTGGAGTGGG<br>TGGCAGCTATATGGTTTGATGCGGCTTTCAAATACT<br>ATGCAGACGCCGTGAAGGGCCGATTCACCATCTCCA<br>GAGACAACTCCAAGAACACGCTGTATCTGCAAATG<br>AACAGCCTGAGAGCCGAGGACACGGCTGTGTATTA<br>CTGTGCGAGAGATCTCGCGATTTTTGGAGTGGTCCC<br>CGACTACTGGGGCCAGGGAACCCTGGTCACCGTGTC<br>TAGT<br>(SEQ ID NO: 958) |
| | AA | EIVMTQSPATLSVSPGERATLSCRASQSVDQHLAWYQ<br>QKPGQAPRLLIYQAATRATGIPARFSGSGSGTEFTLTIS<br>SLQSEDFAVYYCQQYQNWPLTFGGGTKVEIK<br>(SEQ ID NO: 959) | QVQLVESGGGVVQPGRSLRLSCAASGFTFQNYGMHW<br>VRQAPGEGLEWVAAIWFDAAFKYYADAVKGRFTISR<br>DNSKNTLYLQMNSLRAEDTAVYYCARDLAIFGVVPD<br>YWGQGTLVTVSS<br>(SEQ ID NO: 960) |
| iPS: 529381 | NA | ATGGACATGAGGGTGCCCGCTCAGCTCCTGGGGCTC<br>CTGCTGCTGTGGCTGAGAGGTGCGCGCTGTGAAATC<br>GTGATGACGCAGTCTCCAGCCACCCTGTCTGTGTCT<br>CCAGGGGAAAGAGCCACCCTCTCCTGCAGGGCCAG<br>TCAGAGTGTTAGCGAACACTTAGCCTGGTACCAGCA<br>GAAACCTGGCCAGGCTCCCAGGCTCCTCATCTACGA<br>AGCAGCCACCAGGGCCACTGGTATCCCAGCCAGGTT<br>CAGTGGCAGTGGGTCTGGGACAGAGTTCACTCTCAC<br>CATCAGCAGCCTGCAGTCTGAAGATTTTGCAGTT<br>(SEQ ID NO: 1377 | ATGGACATGAGGGTGCCCGCTCAGCTCCTGGGGCTC<br>CTGCTGCTGTGGCTGAGAGGTGCGCGCTGTCAGGTG<br>CAGCTGGTGGAGTCTGGGGGAGGCGTGGTCCAGCC<br>TGGGAGGTCCCTGAGACTCTCCTGTGCAGCATCTGG<br>ATTCACCTTCAGTAACTATGGCATGCACTGGGTCCG<br>CCAGGCTCCAGGCGAGGGGCTGGAGTGGGTGGCAG<br>CTATCTGGTTTGATGCAAGTGATAAATACTATGCAG<br>ACGCCGTGAAGGGCCGATTCACCATCTCCAGAGAC<br>AACTCCAAGAACACGCTGTATCTGCAAATGAACAG<br>CCTGAGAGCCGAGGACACGGCTGTGTATTACTGTGC<br>GAGA<br>(SEQ ID NO: 1378 |
| | AA | EIVMTQSPATLSVSPGERATLSCRASQSVSEHLAWYQ<br>QKPGQAPRLLIYEAATRATGIPARFSGSGSGTEFTLTIS<br>SLQSEDFAVYYCQQYQNWPLTFGGGTKVEIK<br>(SEQ ID NO: 1086) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVIPDY<br>WGQGTLVTVSS<br>(SEQ ID NO: 1287) |
| iPS: 529382 | NA | ATGGACATGAGGGTGCCCGCTCAGCTCCTGGGGCTC<br>CTGCTGCTGTGGCTGAGAGGTGCGCGCTGTGAAATC<br>GTGATGACGCAGTCTCCAGCCACCCTGTCTGTGTCT<br>CCAGGGGAAAGAGCCACCCTCTCCTGCAGGGCCAG<br>TCAGAGTGTTAGCAGCAACTTAGCCTGGTACCAGCA<br>GAAACCTGGCCAGGCTCCCAGGCTCCTCATCTATGG<br>TGCAGCCACCAGGGCCACTGGTATCCCAGCCAGGTT<br>CAGTGGCAGTGGGTCTGGGACAGAGTTCACTCTCAC<br>CATCAGCAGCCTGCAGTCTGAAGATTTTGCAGTT<br>(SEQ ID NO: 1379 | ATGGACATGAGGGTGCCCGCTCAGCTCCTGGGGCTC<br>CTGCTGCTGTGGCTGAGAGGTGCGCGCTGTCAGGTG<br>CAGCTGGTGGAGTCTGGGGGAGGCGTGGTCCAGCC<br>TGGGAGGTCCCTGAGACTCTCCTGTGCAGCATCTGG<br>ATTCACCTTCAGTAACTATGGCATGCACTGGGTCCG<br>CCAGGCTCCAGGCGAGGGGCTGGAGTGGGTGGCAG<br>CTATCTGGTTTGATGCAAGTGATAAATACTATGCAG<br>ACGCCGTGAAGGGCCGATTCACCATCTCCAGAGAC<br>AACTCCAAGAACACGCTGTATCTGCAAATGAACAG<br>CCTGAGAGCCGAGGACACGGCTGTGTATTACTGTGC<br>GAGA<br>(SEQ ID NO: 1380 |
| | AA | EIVMTQSPATLSVSPGERATLSCRASQSVSSNLAWYQQ<br>KPGQAPRLLIYGAATRATGIPARFSGSGSGTEFTLTISS<br>LQSEDFAVYYCQQYNNWPLTFGGGTKVEIK<br>(SEQ ID NO: 1296) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDIAIFGVVPDY<br>WGQGTLVTVSS<br>(SEQ ID NO: 1297) |
| iPS: 529397 | NA | ATGGACATGAGGGTGCCCGCTCAGCTCCTGGGGCTC<br>CTGCTGCTGTGGCTGAGAGGTGCGCGCTGTGAAATC<br>GTGCTGACGCAGTCTCCAGCCACCCTGTCTCTGTCT<br>CCAGGGGAAAGAGCCACCCTCTCCTGCAGGGCCAG<br>TCAGAGTGTTAGCAGCAACTTAGCCTGGTACCAGCA<br>GAAACCTGGCCAGGCTCCCAGGCTCCTCATCTATGG<br>TGCAGCCACCAGGGCCACTGGTATCCCAGACAGGTT<br>CAGTGGCAGTGGGTCTGGGACAGAGTTCACTCTCAC<br>CATCAGCAGGCTGGAGCCTGAAGATTTTGCAGTT<br>(SEQ ID NO: 1381 | ATGGACATGAGGGTGCCCGCTCAGCTCCTGGGGCTC<br>CTGCTGCTGTGGCTGAGAGGTGCGCGCTGTCAGGTG<br>CAGCTGGTGGAGTCTGGGGGAGGCGTGGTCCAGCC<br>TGGGAGGTCCCTGAGACTCTCCTGTGCAGCATCTGG<br>ATTCACCTTCAGTAACTATGGCATGCACTGGGTCCG<br>CCAGGCTCCAGGCGAGGGGCTGGAGTGGGTGGCAG<br>CTATCTGGTTTGATGCAAGTGATAAATACTATGCAG<br>ACGCCGTGAAGGGCCGATTCACCATCTCCAGAGAC<br>AACTCCAAGAACACGCTGTATCTGCAAATGAACAG<br>CCTGAGAGCCGAGGACACGGCTGTGTATTACTGTGC<br>GAGA<br>(SEQ ID NO: 1382 |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVLTQSPATLSLSPGERATLSCRASQSVSSNLAWYQQ<br>KPGQAPRLLIYGAATRATGIPDRFSGSGSGTEFTLTISR<br>LEPEDFAVYYCQQYNNWPLTFGGGTKVEIK<br>(SEQ ID NO: 1306) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDQAIFGVVPD<br>YWGQGTLVTVSS<br>(SEQ ID NO: 1307) |
| iPS: 529399 | NA | ATGGACATGAGGGTGCCCGCTCAGCTCCTGGGGCTC<br>CTGCTGCTGTGGCTGAGAGGTGCGCGCTGTGAAATC<br>GTGCTGACGCAGTCTCCAGCCACCCTGTCTCTGTCT<br>CCAGGGGAAAGAGCCACCCTCTCCTGCAGGGCCAG<br>TCAGAGTGTTAGCGAACACTTAGCCTGGTACCAGCA<br>GAAACCTGGCCAGGCTCCCAGGCTCCTCATCTACGA<br>AGCAGCCACCAGGGCCACTGGTATCCCAGACAGGT<br>TCAGTGGCAGTGGGTCTGGGACAGAGTTCACTCTCA<br>CCATCAGCAGGCTGGAGCCTGAAGATTTTGCAGTT<br>(SEQ ID NO: 1383 | ATGGACATGAGGGTGCCCGCTCAGCTCCTGGGGCTC<br>CTGCTGCTGTGGCTGAGAGGTGCGCGCTGTCAGGTG<br>CAGCTGGTGGAGTCTGGGGGAGGCGTGGTCCAGCC<br>TGGGAGGTCCCTGAGACTCTCCTGTGCAGCATCTGG<br>ATTCACCTTCAGTAACTATGGCATGCACTGGGTCCG<br>CCAGGCTCCAGGCGAGGGGCTGGAGTGGGTGGCAG<br>CTATCTGGTTTGATGCAAGTGATAAATACTATGCAG<br>ACGCCGTGAAGGGCCGATTCACCATCTCCAGAGAC<br>AACTCCAAGAACACGCTGTATCTGCAAATGAACAG<br>CCTGAGAGCCGAGGACACGGCTGTGTATTACTGTGC<br>GAGA<br>(SEQ ID NO: 1384 |
| | AA | EIVLTQSPATLSLSPGERATLSCRASQSVSEHLAWYQQ<br>KPGQAPRLLIYEAATRATGIPDRFSGSGSGTEFTLTISR<br>LEPEDFAVYYCQQYQNWPLTFGGGTKVEIK<br>(SEQ ID NO: 1316) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVIPDY<br>WGQGTLVTVSS<br>(SEQ ID NO: 1317) |
| iPS529400 | NA | ATGGACATGAGGGTGCCCGCTCAGCTCCTGGGGCTC<br>CTGCTGCTGTGGCTGAGAGGTGCGCGCTGTGAAATC<br>GTGCTGACGCAGTCTCCAGCCACCCTGTCTCTGTCT<br>CCAGGGGAAAGAGCCACCCTCTCCTGCAGGGCCAG<br>TCAGAGTGTTAGCAGCAACTTAGCCTGGTACCAGCA<br>GAAACCTGGCCAGGCTCCCAGGCTCCTCATCTATGG<br>TGCAGCCACCAGGGCCACTGGTATCCCAGACAGGTT<br>CAGTGGCAGTGGGTCTGGGACAGAGTTCACTCTCAC<br>CATCAGCAGGCTGGAGCCTGAAGATTTTGCAGTT<br>(SEQ ID NO: 1385 | ATGGACATGAGGGTGCCCGCTCAGCTCCTGGGGCTC<br>CTGCTGCTGTGGCTGAGAGGTGCGCGCTGTCAGGTG<br>CAGCTGGTGGAGTCTGGGGGAGGCGTGGTCCAGCC<br>TGGGAGGTCCCTGAGACTCTCCTGTGCAGCATCTGG<br>ATTCACCTTCAGTAACTATGGCATGCACTGGGTCCG<br>CCAGGCTCCAGGCGAGGGGCTGGAGTGGGTGGCAG<br>CTATCTGGTTTGATGCAAGTGATAAATACTATGCAG<br>ACGCCGTGAAGGGCCGATTCACCATCTCCAGAGAC<br>AACTCCAAGAACACGCTGTATCTGCAAATGAACAG<br>CCTGAGAGCCGAGGACACGGCTGTGTATTACTGTGC<br>GAGA<br>(SEQ ID NO: 1386 |
| | AA | EIVLTQSPATLSLSPGERATLSCRASQSVSSNLAWYQQ<br>KPGQAPRLLIYGAATRATGIPDRFSGSGSGTEFTLTISR<br>LEPEDFAVYYCQQYNNWPLTFGGGTKVEIK<br>(SEQ ID NO: 1326) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDIAIFGVVPDY<br>WGQGTLVTVSS<br>(SEQ ID NO: 1327) |
| iPS: 529403 | NA | ATGGACATGAGGGTGCCCGCTCAGCTCCTGGGGCTC<br>CTGCTGCTGTGGCTGAGAGGTGCGCGCTGTGAAATC<br>GTGCTGACGCAGTCTCCAGCCACCCTGTCTCTGTCT<br>CCAGGGGAAAGAGCCACCCTCTCCTGCAGGGCCAG<br>TCAGAGTGTTGATCTGCACTTAGCCTGGTACCAGCA<br>GAAACCTGGCCAGGCTCCCAGGCTCCTCATCTACGA<br>AGCAGCCACCAGGGCCACTGGTATCCCAGACAGGT<br>TCAGTGGCAGTGGGTCTGGGACAGAGTTCACTCTCA<br>CCATCAGCAGGCTGGAGCCTGAAGATTTTGCAGTT<br>(SEQ ID NO: 1387 | ATGGACATGAGGGTGCCCGCTCAGCTCCTGGGGCTC<br>CTGCTGCTGTGGCTGAGAGGTGCGCGCTGTCAGGTG<br>CAGCTGGTGGAGTCTGGGGGAGGCGTGGTCCAGCC<br>TGGGAGGTCCCTGAGACTCTCCTGTGCAGCATCTGG<br>ATTCACCTTCAGTAACTATGGCATGCACTGGGTCCG<br>CCAGGCTCCAGGCGAGGGGCTGGAGTGGGTGGCAG<br>CTATCTGGTTTGATGCAAGTGATAAATACTATGCAG<br>ACGCCGTGAAGGGCCGATTCACCATCTCCAGAGAC<br>AACTCCAAGAACACGCTGTATCTGCAAATGAACAG<br>CCTGAGAGCCGAGGACACGGCTGTGTATTACTGTGC<br>GAGA<br>(SEQ ID NO: 1388 |
| | AA | EIVLTQSPATLSLSPGERATLSCRASQSVDLHLAWYQQ<br>KPGQAPRLLIYEAATRATGIPDRFSGSGSGTEFTLTISR<br>LEPEDFAVYYCQQYQNWPLTFGGGTKVEIK<br>(SEQ ID NO: 1336) | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDLAIFGVVPD<br>YWGQGTLVTVSS<br>(SEQ ID NO: 1337) |
| iPS: 529404 | NA | ATGGACATGAGGGTGCCCGCTCAGCTCCTGGGGCTC<br>CTGCTGCTGTGGCTGAGAGGTGCGCGCTGTGAAATC<br>GTGCTGACGCAGTCTCCAGCCACCCTGTCTCTGTCT<br>CCAGGGGAAAGAGCCACCCTCTCCTGCAGGGCCAG<br>TCAGAGTGTTAACCTGAACTTAGCCTGGTACCAGCA<br>GAAACCTGGCCAGGCTCCCAGGCTCCTCATCTACCA<br>GGCAGCCACCAGGGCCACTGGTATCCCAGACAGGT<br>TCAGTGGCAGTGGGTCTGGGACAGAGTTCACTCTCA<br>CCATCAGCAGGCTGGAGCCTGAAGATTTTGCAGTT<br>(SEQ ID NO: 1389 | ATGGACATGAGGGTGCCCGCTCAGCTCCTGGGGCTC<br>CTGCTGCTGTGGCTGAGAGGTGCGCGCTGTCAGGTG<br>CAGCTGGTGGAGTCTGGGGGAGGCGTGGTCCAGCC<br>TGGGAGGTCCCTGAGACTCTCCTGTGCAGCATCTGG<br>ATTCACCTTCAGTAACTATGGCATGCACTGGGTCCG<br>CCAGGCTCCAGGCGAGGGGCTGGAGTGGGTGGCAG<br>CTATCTGGTTTGATGCAAGTGATAAATACTATGCAG<br>ACGCCGTGAAGGGCCGATTCACCATCTCCAGAGAC<br>AACTCCAAGAACACGCTGTATCTGCAAATGAACAG<br>CCTGAGAGCCGAGGACACGGCTGTGTATTACTGTGC<br>GAGA<br>(SEQ ID NO: 1390 |

TABLE 3-continued

Exemplary Variable Light and Variable Heavy Regions: Nucleic Acid ("NA") and Amino Acid ("AA") Sequences

| Ab | Type | LC V-region | HC V-region |
|---|---|---|---|
| | AA | EIVLTQSPATLSLSPGERATLSCRASQSVNLNLAWYQQ KPGQAPRLLIYQAATRATGIPDRFSGSGSGTEFTLTISR LEPEDFAVYYCQQYNQWPLTFGGGTKVEIK (SEQ ID NO: 1346) | QVQLVESGGGVVQPGRSLRLSCAASGFTFSNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 1347) |
| iPS: 529405 | NA | ATGGACATGAGGGTGCCCGCTCAGCTCCTGGGGCTC CTGCTGCTGTGGCTGAGAGGTGCGCGCTGTGAAATC GTGCTGACGCAGTCTCCAGCCACCCTGTCTCTGTCT CCAGGGGAAAGAGCCACCCTCTCCTGCAGGGCCAG TCAGAGTGTTTTCAGCCACTTAGCCTGGTACCAGCA GAAACCTGGCCAGGCTCCCAGGCTCCTCATCTACGA AGCAGCCACCAGGGCCACTGGTATCCCAGACAGGT TCAGTGGCAGTGGGTCTGGGACAGAGTTCACTCTCA CCATCAGCAGGCTGGAGCCTGAAGATTTTGCAGTT (SEQ ID NO: 1391 | ATGGACATGAGGGTGCCCGCTCAGCTCCTGGGGCTC CTGCTGCTGTGGCTGAGAGGTGCGCGCTGTCAGGTG CAGCTGGTGGAGTCTGGGGGAGGCGTGGTCCAGCC TGGGAGGTCCCTGAGACTCTCCTGTGCAGCATCTGG ATTCACCTTCCAGAACTATGGCATGCACTGGGTCCG CCAGGCTCCAGGCGAGGGGCTGGAGTGGGTGGCAG CTATCTGGTTTGATGCGTCTGACAAATACTATGCAG ACGCCGTGAAGGGCCGATTCACCATCTCCAGAGAC AACTCCAAGAACACGCTGTATCTGCAAATGAACAG CCTGAGAGCCGAGGACACGGCTGTGTATTACTGTGC GAGA (SEQ ID NO: 1392 |
| | AA | EIVLTQSPATLSLSPGERATLSCRASQSVFSHLAWYQQ KPGQAPRLLIYEAATRATGIPDRFSGSGSGTEFTLTISR LEPEDFAVYYCQQYQNWPLTFGGGTKVEIK (SEQ ID NO: 1356) | QVQLVESGGGVVQPGRSLRLSCAASGFTFQNYGMHW VRQAPGEGLEWVAAIWFDASDKYYADAVKGRFTISR DNSKNTLYLQMNSLRAEDTAVYYCARDLAIFGVVPD YWGQGTLVTVSS (SEQ ID NO: 1357) |

Table 4. Exemplary CDRL1, CDRL2, CDRL3, CDRH1, CDRH2, and CDRH3 Nucleic Acid ("NA") and Amino Acid ("AA") Sequences

TABLE 4A

Exemplary CDRL1, CDRL2, and CDRL3 Nucleic Acid ("NA") and Amino Acid ("AA") Sequences

| Ab | Type | CDRL1 | CDRL2 | CDRL3 |
|---|---|---|---|---|
| 2G10.303 | NA | AGGGCCAGTCAGAGTGTTGATAG ACACTTAGCC (SEQ ID NO: 1) | GAAGCAGCCACCAGGGCCACT (SEQ ID NO: 2) | CAGCAGTATCAGAACTGGCCTCT CACT (SEQ ID NO: 3) |
| | AA | RASQSVDRHLA (SEQ ID NO: 4) | EAATRAT (SEQ ID NO: 5) | QQYQNWPLT (SEQ ID NO: 6) |
| 2G10.304 | NA | AGGGCCAGTCAGAGTGTTAACAG ACACTTAGCC (SEQ ID NO: 7) | GAAGCAGCCACCAGGGCCACT (SEQ ID NO: 8) | CAGCAGTATCAGAACTGGCCTCT CACT (SEQ ID NO: 9) |
| | AA | RASQSVNRHLA (SEQ ID NO: 10) | EAATRAT (SEQ ID NO: 11) | QQYQNWPLT (SEQ ID NO: 12) |
| 2G10.323 | NA | AGGGCCAGTCAGAGTGTTCATAG ACACTTAGCC (SEQ ID NO: 13) | GAAGCAGCCACCAGGGCCACT (SEQ ID NO: 14) | CAGCAGTATCAGAACTGGCCTCT CACT (SEQ ID NO: 15) |
| | AA | RASQSVHRHLA (SEQ ID NO: 16) | EAATRAT (SEQ ID NO: 17) | QQYQNWPLT (SEQ ID NO: 18) |
| 2G10.309 | NA | AGGGCCAGTCAGAGTGTTGAAAG ACACTTAGCC (SEQ ID NO: 19) | GAAGCAGCCACCAGGGCCACT (SEQ ID NO: 20) | CAGCAGTATCAGAACTGGCCTCT CACT (SEQ ID NO: 21) |
| | AA | RASQSVERHLA (SEQ ID NO: 22) | EAATRAT (SEQ ID NO: 23) | QQYQNWPLT (SEQ ID NO: 24) |
| 2G10.316 | NA | AGGGCCAGTCAGAGTGTTTTCAG ACACTTAGCC (SEQ ID NO: 25) | GAAGCAGCCACCAGGGCCACT (SEQ ID NO: 26) | CAGCAGTATCAGAACTGGCCTCT CACT (SEQ ID NO: 27) |
| | AA | RASQSVFRHLA (SEQ ID NO: 28) | EAATRAT (SEQ ID NO: 29) | QQYQNWPLT (SEQ ID NO: 30) |

TABLE 4A-continued

Exemplary CDRL1, CDRL2, and CDRL3 Nucleic Acid ("NA") and Amino Acid ("AA") Sequences

| Ab | Type | CDRL1 | CDRL2 | CDRL3 |
|---|---|---|---|---|
| 2G10.604 | NA | AGGGCCAGTCAGAGTGTTAACAG ACACTTAGCC (SEQ ID NO: 31) | GAAGCAGCCACCAGGGCCACT (SEQ ID NO: 32) | CAGCAGTATCAGAACTGGCCTCT CACT (SEQ ID NO: 33) |
| | AA | RASQSVNRHLA (SEQ ID NO: 34) | EAATRAT (SEQ ID NO: 35) | QQYQNWPLT (SEQ ID NO: 36) |
| 2G10.609 | NA | AGGGCCAGTCAGAGTGTTGAAAG ACACTTAGCC (SEQ ID NO: 37) | GAAGCAGCCACCAGGGCCACT (SEQ ID NO: 38) | CAGCAGTATCAGAACTGGCCTCT CACT (SEQ ID NO: 39) |
| | AA | RASQSVERHLA (SEQ ID NO: 40) | EAATRAT (SEQ ID NO: 41) | QQYQNWPLT (SEQ ID NO: 42) |
| 2G10.603 | NA | AGGGCCAGTCAGAGTGTTGATAG ACACTTAGCC (SEQ ID NO: 43) | GAAGCAGCCACCAGGGCCACT (SEQ ID NO: 44) | CAGCAGTATCAGAACTGGCCTCT CACT (SEQ ID NO: 45) |
| | AA | RASQSVDRHLA (SEQ ID NO: 46) | EAATRAT (SEQ ID NO: 47) | QQYQNWPLT (SEQ ID NO: 48) |
| 2G10.318 | NA | AGGGCCAGTCAGAGTGTTCTGAG TCACTTAGCC (SEQ ID NO: 49) | GAAGCAGCCACCAGGGCCACT (SEQ ID NO: 50) | CAGCAGTATAACAACTGGCCTCT CACT (SEQ ID NO: 51) |
| | AA | RASQSVLSHLA (SEQ ID NO: 52) | EAATRAT (SEQ ID NO: 53) | QQYNNWPLT (SEQ ID NO: 54) |
| 2G10.324 | NA | AGGGCCAGTCAGAGTGTTCTGAG TCACTTAGCC (SEQ ID NO: 55) | GAAGCAGCCACCAGGGCCACT (SEQ ID NO: 56) | CAGCAGTATCAGAACTGGCCTCT CACT (SEQ ID NO: 57) |
| | AA | RASQSVLSHLA (SEQ ID NO: 58) | EAATRAT (SEQ ID NO: 59) | QQYQNWPLT (SEQ ID NO: 60) |
| 2G10.322 | NA | AGGGCCAGTCAGAGTGTTATGAG TCACTTAGCC (SEQ ID NO: 61) | GAAGCAGCCACCAGGGCCACT (SEQ ID NO: 62) | CAGCAGTATCAGAACTGGCCTCT CACT (SEQ ID NO: 63) |
| | AA | RASQSVMSHLA (SEQ ID NO: 64) | EAATRAT (SEQ ID NO: 65) | QQYQNWPLT (SEQ ID NO: 66) |
| 2G10.315 | NA | AGGGCCAGTCAGAGTGTTCTGAC GCACTTAGCC (SEQ ID NO: 67) | GAAGCAGCCACCAGGGCCACT (SEQ ID NO: 68) | CAGCAGTATCAGAACTGGCCTCT CACT (SEQ ID NO: 69) |
| | AA | RASQSVLTHLA (SEQ ID NO: 70) | EAATRAT (SEQ ID NO: 71) | QQYQNWPLT (SEQ ID NO: 72) |
| 2G10.331 | NA | AGGGCCAGTCAGAGTGTTGATCT GCACTTAGCC (SEQ ID NO: 73) | GAAGCAGCCACCAGGGCCACT (SEQ ID NO: 74) | CAGCAGTATCAGAACTGGCCTCT CACT (SEQ ID NO: 75) |
| | AA | RASQSVDLHLA (SEQ ID NO: 76) | EAATRAT (SEQ ID NO: 77) | QQYQNWPLT (SEQ ID NO: 78) |
| 2G10.320 | NA | AGGGCCAGTCAGAGTGTTAGCGA ACACTTAGCC (SEQ ID NO: 79) | GAAGCAGCCACCAGGGCCACT (SEQ ID NO: 80) | CAGCAGTATCAGAACTGGCCTCT CACT (SEQ ID NO: 81) |
| | AA | RASQSVSEHLA (SEQ ID NO: 82) | EAATRAT (SEQ ID NO: 83) | QQYQNWPLT (SEQ ID NO: 84) |
| 2G10.328 | NA | AGGGCCAGTCAGAGTGTTAGCGA ACACTTAGCC (SEQ ID NO: 85) | GAAGCAGCCACCAGGGCCACT (SEQ ID NO: 86) | CAGCAGTATCAGAACTGGCCTCT CACT (SEQ ID NO: 87) |
| | AA | RASQSVSEHLA (SEQ ID NO: 88) | EAATRAT (SEQ ID NO: 89) | QQYQNWPLT (SEQ ID NO: 90) |
| 2G10.333 | NA | AGGGCCAGTCAGAGTGTTAGCCG GCACTTAGCC (SEQ ID NO: 91) | GAAGCAGCCACCAGGGCCACT (SEQ ID NO: 92) | CAGCAGTATCAGCACTGGCCTCT CACT (SEQ ID NO: 93) |

TABLE 4A-continued

Exemplary CDRL1, CDRL2, and CDRL3 Nucleic Acid ("NA") and Amino Acid ("AA") Sequences

| Ab | Type | CDRL1 | CDRL2 | CDRL3 |
|---|---|---|---|---|
| | AA | RASQSVSRHLA (SEQ ID NO: 94) | EAATRAT (SEQ ID NO: 95) | QQYQHWPLT (SEQ ID NO: 11) |
| 2G10.301 | NA | AGGGCCAGTCAGAGTGTTTTCAG CCACTTAGCC (SEQ ID NO: 97) | GAAGCAGCCACCAGGGCCACT (SEQ ID NO: 98) | CAGCAGTATCAGAACTGGCCTCT CACT (SEQ ID NO: 99) |
| | AA | RASQSVFSHLA (SEQ ID NO: 100) | EAATRAT (SEQ ID NO: 101) | QQYQNWPLT (SEQ ID NO: 102) |
| 2G10.601 | NA | AGGGCCAGTCAGAGTGTTTTCAG CCACTTAGCC (SEQ ID NO: 103) | GAAGCAGCCACCAGGGCCACT (SEQ ID NO: 104) | CAGCAGTATCAGAACTGGCCTCT CACT (SEQ ID NO: 105) |
| | AA | RASQSVFSHLA (SEQ ID NO: 106) | EAATRAT (SEQ ID NO: 107) | QQYQNWPLT (SEQ ID NO: 108) |
| 2G10.326 | NA | AGGGCCAGTCAGAGTGTTCTGAG TCACTTAGCC (SEQ ID NO: 109) | GAAGCAGCCACCAGGGCCACT (SEQ ID NO: 110) | CAGCAGTATCAGCAGTGGCCTCT CACT (SEQ ID NO: 111) |
| | AA | RASQSVLSHLA (SEQ ID NO: 112) | EAATRAT (SEQ ID NO: 113) | QQYQQWPLT (SEQ ID NO: 114) |
| 2G10.308 | NA | AGGGCCAGTCAGAGTGTTTTCAG CCACTTAGCC (SEQ ID NO: 115) | GAAGCAGCCACCAGGGCCACT (SEQ ID NO: 116) | CAGCAGTATCAGCAGTGGCCTCT CACT (SEQ ID NO: 117) |
| | AA | RASQSVFSHLA (SEQ ID NO: 118) | EAATRAT (SEQ ID NO: 119) | QQYQQWPLT (SEQ ID NO: 120) |
| 2G10.608 | NA | AGGGCCAGTCAGAGTGTTTTCAG CCACTTAGCC (SEQ ID NO: 121) | GAAGCAGCCACCAGGGCCACT (SEQ ID NO: 122) | CAGCAGTATCAGCAGTGGCCTCT CACT (SEQ ID NO: 123) |
| | AA | RASQSVFSHLA (SEQ ID NO: 124) | EAATRAT (SEQ ID NO: 125) | QQYQQWPLT (SEQ ID NO: 126) |
| 2G10.336 | NA | AGGGCCAGTCAGAGTGTTCAGAG CCACTTAGCC (SEQ ID NO: 127) | GAAGCAGCCACCAGGGCCACT (SEQ ID NO: 128) | CAGCAGTATCAGAACTGGCCTCT CACT (SEQ ID NO: 129) |
| | AA | RASQSVQSHLA (SEQ ID NO: 130) | EAATRAT (SEQ ID NO: 131) | QQYQNWPLT (SEQ ID NO: 132) |
| 2G10.344 | NA | AGGGCCAGTCAGAGTGTTAGTAG CCACTTAGCC (SEQ ID NO: 133) | GAAGCAGCCACCAGGGCCACT (SEQ ID NO: 134) | CAGCAGTATCAGCAGTGGCCTCT CACT (SEQ ID NO: 135) |
| | AA | RASQSVSSHLA (SEQ ID NO: 136) | EAATRAT (SEQ ID NO: 137) | QQYQQWPLT (SEQ ID NO: 138) |
| 2G10.310 | NA | AGGGCCAGTCAGAGTGTTTTCAC GCACTTAGCC (SEQ ID NO: 139) | GAAGCAGCCACCAGGGCCACT (SEQ ID NO: 140) | CAGCAGTATAACAACTGGCCTCT CACT (SEQ ID NO: 141) |
| | AA | RASQSVFTHLA (SEQ ID NO: 142) | EAATRAT (SEQ ID NO: 143) | QQYNNWPLT (SEQ ID NO: 144) |
| 2G10.610 | NA | AGGGCCAGTCAGAGTGTTTTCAC GCACTTAGCC (SEQ ID NO: 145) | GAAGCAGCCACCAGGGCCACT (SEQ ID NO: 146) | CAGCAGTATAACAACTGGCCTCT CACT (SEQ ID NO: 147) |
| | AA | RASQSVFTHLA (SEQ ID NO: 148) | EAATRAT (SEQ ID NO: 149) | QQYNNWPLT (SEQ ID NO: 150) |
| 2G10.312 | NA | AGGGCCAGTCAGAGTGTTTTTGA ACACTTAGCC (SEQ ID NO: 151) | GAAGCAGCCACCAGGGCCACT (SEQ ID NO: 152) | CAGCAGTATAACAACTGGCCTCT CACT (SEQ ID NO: 153) |
| | AA | RASQSVFEHLA (SEQ ID NO: 154) | EAATRAT (SEQ ID NO: 155) | QQYNNWPLT (SEQ ID NO: 156) |

TABLE 4A-continued

| Exemplary CDRL1, CDRL2, and CDRL3 Nucleic Acid ("NA") and Amino Acid ("AA") Sequences | | | | |
|---|---|---|---|---|
| Ab | Type | CDRL1 | CDRL2 | CDRL3 |
| 2G10.329 | NA | AGGGCCAGTCAGAGTGTTGAACA GCACTTAGCC (SEQ ID NO: 157) | GAAGCAGCCACCAGGGCCACT (SEQ ID NO: 158) | CAGCAGTATAACAACTGGCCTCT CACT (SEQ ID NO: 159) |
| | AA | RASQSVEQHLA (SEQ ID NO: 160) | EAATRAT (SEQ ID NO: 161) | QQYNNWPLT (SEQ ID NO: 162) |
| 2G10.327 | NA | AGGGCCAGTCAGAGTGTTCATAG CCACTTAGCC (SEQ ID NO: 163) | GAAGCAGCCACCAGGGCCACT (SEQ ID NO: 164) | CAGCAGTATAACCAGTGGCCTCT CACT (SEQ ID NO: 165) |
| | AA | RASQSVHSHLA (SEQ ID NO: 166) | EAATRAT (SEQ ID NO: 167) | QQYNQWPLT (SEQ ID NO: 168) |
| SG10.338 | NA | AGGGCCAGTCAGAGTGTTCATCA TCACTTAGCC (SEQ ID NO: 169) | GAAGCAGCCACCAGGGCCACT (SEQ ID NO: 170) | CAGCAGTATAACCAGTGGCCTCT CACT (SEQ ID NO: 171) |
| | AA | RASQSVHHHLA (SEQ ID NO: 172) | EAATRAT (SEQ ID NO: 173) | QQYNQWPLT (SEQ ID NO: 174) |
| 2G10.314 | NA | AGGGCCAGTCAGAGTGTTCATAG CCACTTAGCC (SEQ ID NO: 175) | GAAGCAGCCACCAGGGCCACT (SEQ ID NO: 176) | CAGCAGTATAACAACTGGCCTCT CACT (SEQ ID NO: 177) |
| | AA | RASQSVHSHLA (SEQ ID NO: 178) | EAATRAT (SEQ ID NO: 179) | QQYNNWPLT (SEQ ID NO: 180) |
| 2G10.337 | NA | AGGGCCAGTCAGAGTGTTGATGT CAACTTAGCC (SEQ ID NO: 181) | GAAGCAGCCACCAGGGCCACT (SEQ ID NO: 182) | CAGCAGTATAACCAGTGGCCTCT CACT (SEQ ID NO: 183) |
| | AA | RASQSVDVNLA (SEQ ID NO: 184) | EAATRAT (SEQ ID NO: 185) | QQYNQWPLT (SEQ ID NO: 186) |
| 2G10.341 | NA | AGGGCCAGTCAGAGTGTTGATGT CCACTTAGCC (SEQ ID NO: 187) | GAAGCAGCCACCAGGGCCACT (SEQ ID NO: 188) | CAGCAGTATAACCAGTGGCCTCT CACT (SEQ ID NO: 189) |
| | AA | RASQSVDVHLA (SEQ ID NO: 190) | EAATRAT (SEQ ID NO: 191) | QQYNQWPLT (SEQ ID NO: 192) |
| 2G10.302 | NA | AGGGCCAGTCAGAGTGTTTTTGA ACACTTAGCC (SEQ ID NO: 193) | GAAGCAGCCACCAGGGCCACT (SEQ ID NO: 194) | CAGCAGTATAACAACTGGCCTCT CACT (SEQ ID NO: 195) |
| | AA | RASQSVFEHLA (SEQ ID NO: 196) | EAATRAT (SEQ ID NO: 197) | QQYNNWPLT (SEQ ID NO: 198) |
| 2G10.602 | NA | AGGGCCAGTCAGAGTGTTTTTGA ACACTTAGCC (SEQ ID NO: 199) | GAAGCAGCCACCAGGGCCACT (SEQ ID NO: 200) | CAGCAGTATAACAACTGGCCTCT CACT (SEQ ID NO: 201) |
| | AA | RASQSVFEHLA (SEQ ID NO: 202) | EAATRAT (SEQ ID NO: 203) | QQYNNWPLT (SEQ ID NO: 204) |
| 2G10.325 | NA | AGGGCCAGTCAGAGTGTTTTCGA ACACTTAGCC (SEQ ID NO: 205) | GAAGCAGCCACCAGGGCCACT (SEQ ID NO: 206) | CAGCAGTATAACCAGTGGCCTCT CACT (SEQ ID NO: 207) |
| | AA | RASQSVFEHLA (SEQ ID NO: 208) | EAATRAT (SEQ ID NO: 209) | QQYNQWPLT (SEQ ID NO: 210) |
| 2G10.343 | NA | AGGGCCAGTCAGAGTGTTCTGGA ACACTTAGCC (SEQ ID NO: 211) | GAAGCAGCCACCAGGGCCACT (SEQ ID NO: 212) | CAGCAGTATAACAACTGGCCTCT CACT (SEQ ID NO: 213) |
| | AA | RASQSVLEHLA (SEQ ID NO: 214) | EAATRAT (SEQ ID NO: 215) | QQYNNWPLT (SEQ ID NO: 216) |
| 2G10.313 | NA | AGGGCCAGTCAGAGTGTTGATAG ACACTTAGCC (SEQ ID NO: 217) | GAAGCAGCCACCAGGGCCACT (SEQ ID NO: 218) | CAGCAGTATAACCAGTGGCCTCT CACT (SEQ ID NO: 219) |

TABLE 4A-continued

Exemplary CDRL1, CDRL2, and CDRL3 Nucleic Acid ("NA") and Amino Acid ("AA") Sequences

| Ab | Type | CDRL1 | CDRL2 | CDRL3 |
|---|---|---|---|---|
| | AA | RASQSVDRHLA (SEQ ID NO: 220) | EAATRAT (SEQ ID NO: 221) | QQYNQWPLT (SEQ ID NO: 222) |
| 2G10.317 | NA | AGGGCCAGTCAGAGTGTTAACCG GCACTTAGCC (SEQ ID NO: 223) | GAAGCAGCCACCAGGGCCACT (SEQ ID NO: 224) | CAGCAGTATCAGCAGTGGCCTCT CACT (SEQ ID NO: 225) |
| | AA | RASQSVNRHLA (SEQ ID NO: 226) | EAATRAT (SEQ ID NO: 227) | QQYQQWPLT (SEQ ID NO: 228) |
| 2G10.311 | NA | AGGGCCAGTCAGAGTGTTAACGT ACACTTAGCC (SEQ ID NO: 229) | CAGGCAGCCACCAGGGCCACT (SEQ ID NO: 230) | CAGCAGTATAACCAGTGGCCTCT CACT (SEQ ID NO: 231) |
| | AA | RASQSVNVHLA (SEQ ID NO: 232) | QAATRAT (SEQ ID NO: 233) | QQYNQWPLT (SEQ ID NO: 234) |
| 2G10.306 | NA | AGGGCCAGTCAGAGTGTTCTGAC GCACTTAGCC (SEQ ID NO: 235) | GAAGCAGCCACCAGGGCCACT (SEQ ID NO: 236) | CAGCAGTATCAGAACTGGCCTCT CACT (SEQ ID NO: 237) |
| | AA | RASQSVLTHLA (SEQ ID NO: 238) | EAATRAT (SEQ ID NO: 239) | QQYQNWPLT (SEQ ID NO: 240) |
| 2G10.606 | NA | AGGGCCAGTCAGAGTGTTCTGAC GCACTTAGCC (SEQ ID NO: 241) | GAAGCAGCCACCAGGGCCACT (SEQ ID NO: 242) | CAGCAGTATCAGAACTGGCCTCT CACT (SEQ ID NO: 243) |
| | AA | RASQSVLTHLA (SEQ ID NO: 244) | EAATRAT (SEQ ID NO: 245) | QQYQNWPLT (SEQ ID NO: 246) |
| 2G10.347 | NA | AGGGCCAGTCAGAGTGTTAGCAG CAACTTAGCC (SEQ ID NO: 247) | GGTGCAGCCACCAGGGCCACT (SEQ ID NO: 248) | CAGCAGTATAATAACTGGCCTCT CACT (SEQ ID NO: 249) |
| | AA | RASQSVSSNLA (SEQ ID NO: 250) | GAATRAT (SEQ ID NO: 251) | QQYNNWPLT (SEQ ID NO: 252) |
| 2G10.348 | NA | AGGGCCAGTCAGAGTGTTAGCAG CAACTTAGCC (SEQ ID NO: 253) | GGTGCAGCCACCAGGGCCACT (SEQ ID NO: 254) | CAGCAGTATAATAACTGGCCTCT CACT (SEQ ID NO: 255) |
| | AA | RASQSVSSNLA (SEQ ID NO: 256) | GAATRAT (SEQ ID NO: 257) | QQYNNWPLT (SEQ ID NO: 258) |
| 2G10.346 | NA | AGGGCCAGTCAGAGTGTTAGCAG CAACTTAGCC (SEQ ID NO: 259) | GGTGCAGCCACCAGGGCCACT (SEQ ID NO: 260) | CAGCAGTATAATAACTGGCCTCT CACT (SEQ ID NO: 261) |
| | AA | RASQSVSSNLA (SEQ ID NO: 262) | GAATRAT (SEQ ID NO: 263) | QQYNNWPLT (SEQ ID NO: 264) |
| 2G10.647 | NA | AGGGCCAGTCAGAGTGTTAGCAG CAACTTAGCC (SEQ ID NO: 265) | GGTGCAGCCACCAGGGCCACT (SEQ ID NO: 266) | CAGCAGTATAATAACTGGCCTCT CACT (SEQ ID NO: 267) |
| | AA | RASQSVSSNLA (SEQ ID NO: 268) | GAATRAT (SEQ ID NO: 269) | QQYNNWPLT (SEQ ID NO: 270) |
| 2G10.649 | NA | AGGGCCAGTCAGAGTGTTAGCAG CAACTTAGCC (SEQ ID NO: 271) | GAAGCAGCCACCAGGGCCACT (SEQ ID NO: 272) | CAGCAGTATAATAACTGGCCTCT CACT (SEQ ID NO: 273) |
| | AA | RASQSVSSNLA (SEQ ID NO: 274) | EAATRAT (SEQ ID NO: 275) | QQYNNWPLT (SEQ ID NO: 276) |
| 2G10.305 | NA | AGGGCCAGTCAGAGTGTTGATGT TAACTTAGCC (SEQ ID NO: 277) | AACGCAGCCACCAGGGCCACT (SEQ ID NO: 278) | CAGCAGTATCAGAACTGGCCTCT CACT (SEQ ID NO: 279) |
| | AA | RASQSVDVNLA (SEQ ID NO: 280) | NAATRAT (SEQ ID NO: 281) | QQYQNWPLT (SEQ ID NO: 282) |

TABLE 4A-continued

| Exemplary CDRL1, CDRL2, and CDRL3 Nucleic Acid ("NA") and Amino Acid ("AA") Sequences | | | | |
|---|---|---|---|---|
| Ab | Type | CDRL1 | CDRL2 | CDRL3 |
| 2G10.605 | NA | AGGGCCAGTCAGAGTGTTGATGT TAACTTAGCC (SEQ ID NO: 283) | AACGCAGCCACCAGGGCCACT (SEQ ID NO: 284) | CAGCAGTATCAGAACTGGCCTCT CACT (SEQ ID NO: 285) |
| | AA | RASQSVDVNLA (SEQ ID NO: 286) | NAATRAT (SEQ ID NO: 287) | QQYQNWPLT (SEQ ID NO: 288) |
| 2G10.340 | NA | AGGGCCAGTCAGAGTGTTCATAC GAACTTAGCC (SEQ ID NO: 289) | AACGCAGCCACCAGGGCCACT (SEQ ID NO: 290) | CAGCAGTATCAGAACTGGCCTCT CACT (SEQ ID NO: 291) |
| | AA | RASQSVHTNLA (SEQ ID NO: 292) | NAATRAT (SEQ ID NO: 293) | QQYQNWPLT (SEQ ID NO: 294) |
| 2G10.334 | NA | AGGGCCAGTCAGAGTGTTAACCT GAACTTAGCC (SEQ ID NO: 295) | CAGGCAGCCACCAGGGCCACT (SEQ ID NO: 296) | CAGCAGTATAACCAGTGGCCTCT CACT (SEQ ID NO: 297) |
| | AA | RASQSVNLNLA (SEQ ID NO: 298) | QAATRAT (SEQ ID NO: 299) | QQYNQWPLT (SEQ ID NO: 300) |
| 2G10.339 | NA | AGGGCCAGTCAGAGTGTTTTCCA GAACTTAGCC (SEQ ID NO: 301) | CAGGCAGCCACCAGGGCCACT (SEQ ID NO: 302) | CAGCAGTATAACCAGTGGCCTCT CACT (SEQ ID NO: 303) |
| | AA | RASQSVFQNLA (SEQ ID NO: 304) | QAATRAT (SEQ ID NO: 305) | QQYNQWPLT (SEQ ID NO: 306) |
| 2G10.307 | NA | AGGGCCAGTCAGAGTGTTGATAG ACACTTAGCC (SEQ ID NO: 307) | GAAGCAGCCACCAGGGCCACT (SEQ ID NO: 308) | CAGCAGTATAACCAGTGGCCTCT CACT (SEQ ID NO: 309) |
| | AA | RASQSVDRHLA (SEQ ID NO: 310) | EAATRAT (SEQ ID NO: 311) | QQYNQWPLT (SEQ ID NO: 312) |
| 2G10.607 | NA | AGGGCCAGTCAGAGTGTTGATAG ACACTTAGCC (SEQ ID NO: 313) | GAAGCAGCCACCAGGGCCACT (SEQ ID NO: 314) | CAGCAGTATAACCAGTGGCCTCT CACT (SEQ ID NO: 315) |
| | AA | RASQSVDRHLA (SEQ ID NO: 316) | EAATRAT (SEQ ID NO: 317) | QQYNQWPLT (SEQ ID NO: 318) |
| 2G10.321 | NA | AGGGCCAGTCAGAGTGTTAACCG GCACTTAGCC (SEQ ID NO: 319) | GAAGCAGCCACCAGGGCCACT (SEQ ID NO: 320) | CAGCAGTATAACCAGTGGCCTCT CACT (SEQ ID NO: 321) |
| | AA | RASQSVNRHLA (SEQ ID NO: 322) | EAATRAT (SEQ ID NO: 323) | QQYNQWPLT (SEQ ID NO: 324) |
| 2G10.342 | NA | AGGGCCAGTCAGAGTGTTGAAAG ACACTTAGCC (SEQ ID NO: 325) | GAAGCAGCCACCAGGGCCACT (SEQ ID NO: 326) | CAGCAGTATCAGCAGTGGCCTCT CACT (SEQ ID NO: 327) |
| | AA | RASQSVERHLA (SEQ ID NO: 328) | EAATRAT (SEQ ID NO: 329) | QQYQQWPLT (SEQ ID NO: 330) |
| 2G10.319 | NA | AGGGCCAGTCAGAGTGTTTTCAG ACACTTAGCC (SEQ ID NO: 331) | GAAGCAGCCACCAGGGCCACT (SEQ ID NO: 332) | CAGCAGTATCAGAACTGGCCTCT CACT (SEQ ID NO: 333) |
| | AA | RASQSVFRHLA (SEQ ID NO: 334) | EAATRAT (SEQ ID NO: 335) | QQYQNWPLT (SEQ ID NO: 336) |
| 2G10.332 | NA | AGGGCCAGTCAGAGTGTTCTGAG TCACTTAGCC (SEQ ID NO: 337) | GAAGCAGCCACCAGGGCCACT (SEQ ID NO: 338) | CAGCAGTATAACAACTGGCCTCT CACT (SEQ ID NO: 339) |
| | AA | RASQSVLSHLA (SEQ ID NO: 340) | EAATRAT (SEQ ID NO: 341) | QQYNNWPLT (SEQ ID NO: 342) |
| 2G10.345 | NA | AGGGCCAGTCAGAGTGTTAACAG ACACTTAGCC (SEQ ID NO: 343) | GAAGCAGCCACCAGGGCCACT (SEQ ID NO: 344) | CAGCAGTATAACAACTGGCCTCT CACT (SEQ ID NO: 345) |

TABLE 4A-continued

Exemplary CDRL1, CDRL2, and CDRL3 Nucleic Acid ("NA") and Amino Acid ("AA") Sequences

| Ab | Type | CDRL1 | CDRL2 | CDRL3 |
|---|---|---|---|---|
| | AA | RASQSVNRHLA (SEQ ID NO: 346) | EAATRAT (SEQ ID NO: 347) | QQYNNWPLT (SEQ ID NO: 348) |
| 2G10.335 | NA | AGGGCCAGTCAGAGTGTTACCAG CCACTTAGCC (SEQ ID NO: 349) | GAAGCAGCCACCAGGGCCACT (SEQ ID NO: 350) | CAGCAGTATAACCAGTGGCCTCT CACT (SEQ ID NO: 351) |
| | AA | RASQSVTSHLA (SEQ ID NO: 352) | EAATRAT (SEQ ID NO: 353) | QQYNQWPLT (SEQ ID NO: 354) |
| 2G10.330 | NA | AGGGCCAGTCAGAGTGTTGATCA GCACTTAGCC (SEQ ID NO: 355) | CAGGCAGCCACCAGGGCCACT (SEQ ID NO: 356) | CAGCAGTATCAGAACTGGCCTCT CACT (SEQ ID NO: 357) |
| | AA | RASQSVDQHLA (SEQ ID NO: 358) | QAATRAT (SEQ ID NO: 359) | QQYQNWPLT (SEQ ID NO: 360) |
| iPS: 529381 | AA | RASQSVSEHLA (SEQ ID NO: 1290) | EAATRAT (SEQ ID NO: 1291) | QQYQNWPLT (SEQ ID NO: 1292) |
| iPS: 529382 | AA | RASQSVSSNLA (SEQ ID NO: 1300) | GAATRAT (SEQ ID NO: 1301) | QQYNNWPLT (SEQ ID NO: 1302) |
| iPS: 529397 | AA | RASQSVSSNLA (SEQ ID NO: 1310) | GAATRAT (SEQ ID NO: 1311) | QQYNNWPLT (SEQ ID NO: 1312) |
| iPS: 529399 | AA | RASQSVSEHLA (SEQ ID NO: 1320) | EAATRAT (SEQ ID NO: 1321) | QQYQNWPLT (SEQ ID NO: 1322) |
| iPS: 529400 | AA | RASQSVSSNLA (SEQ ID NO: 1330) | GAATRAT (SEQ ID NO: 1331) | QQYNNWPLT (SEQ ID NO: 1332) |
| iPS: 529403 | AA | RASQSVDLHLA (SEQ ID NO: 1340) | EAATRAT (SEQ ID NO: 1341) | QQYQNWPLT (SEQ ID NO: 1342) |
| iPS: 529404 | AA | RASQSVNLNLA (SEQ ID NO: 1350) | QAATRAT (SEQ ID NO: 1351) | QQYNQWPLT (SEQ ID NO: 1352) |
| iPS: 529405 | AA | RASQSVFSHLA (SEQ ID NO: 1360) | EAATRAT (SEQ ID NO: 1361) | QQYQNWPLT (SEQ ID NO: 1362) |

TABLE 4B

Exemplary CDRH1, CDRH2, and CDRH3 Nucleotide and Amino Acid Sequences

| Ab | Type | CDRH1 | CDRH2 | CDRH3 |
|---|---|---|---|---|
| 2G10.303 | NA | AACTATGGCATGCAC (SEQ ID NO: 361) | GCTATATGGTTTGATGCAAGTGA TAAATACTATGCAGACGCCGTGA AGGGC (SEQ ID NO: 362) | GATTTGGCGATTTTTGGAGTGGT CCCCGACTAC (SEQ ID NO: 363) |
| | AA | NYGMH (SEQ ID NO: 364) | AIWFDASDKYYADAVKG (SEQ ID NO: 365) | DLAIFGVVPDY (SEQ ID NO: 366) |
| 2G10.304 | NA | AACTATGGCATGCAC (SEQ ID NO: 367) | GCTATATGGTTTGATGCAAGTGA TAAATACTATGCAGACGCCGTGA AGGGC (SEQ ID NO: 368) | GATTTGGCGATTTTTGGAGTGGT CCCCGACTAC (SEQ ID NO: 369) |
| | AA | NYGMH (SEQ ID NO: 370) | AIWFDASDKYYADAVKG (SEQ ID NO: 371) | DLAIFGVVPDY (SEQ ID NO: 372) |
| 2G10.323 | NA | AACTATGGCATGCAC (SEQ ID NO: 373) | GCTATATGGTTTGATGCAAGTGA TAAATACTATGCAGACGCCGTGA AGGGC (SEQ ID NO: 374) | GATTTGGCGATTTTTGGAGTGGT CCCCGACTAC (SEQ ID NO: 375) |
| | AA | NYGMH (SEQ ID NO: 376) | AIWFDASDKYYADAVKG (SEQ ID NO: 377) | DLAIFGVVPDY (SEQ ID NO: 378) |

TABLE 4B-continued

| Exemplary CDRH1, CDRH2, and CDRH3 Nucleotide and Amino Acid Sequences | | | | |
|---|---|---|---|---|
| Ab | Type | CDRH1 | CDRH2 | CDRH3 |
| 2G10.309 | NA | AACTATGGCATGCAC (SEQ ID NO: 379) | GCTATATGGTTTGATGCAAGTGATAAATACTATGCAGACGCCGTGAAGGGC (SEQ ID NO: 380) | GATTTGGCGATTTTTGGAGTGGTCCCCGACTAC (SEQ ID NO: 381) |
| | AA | NYGMH (SEQ ID NO: 382) | AIWFDASDKYYADAVKG (SEQ ID NO: 383) | DLAIFGVVPDY (SEQ ID NO: 384) |
| 2G10.316 | NA | AACTATGGCATGCAC (SEQ ID NO: 385) | GCTATATGGTTTGATGCAAGTGATAAATACTATGCAGACGCCGTGAAGGGC (SEQ ID NO: 386) | GATTTGGCGATTTTTGGAGTGGTCCCCGACTAC (SEQ ID NO: 387) |
| | AA | NYGMH (SEQ ID NO: 388) | AIWFDASDKYYADAVKG (SEQ ID NO: 389) | DLAIFGVVPDY (SEQ ID NO: 390) |
| 2G10.604 | NA | AACTATGGCATGCAC (SEQ ID NO: 391) | GCTATATGGTTTGATGCAAGTGATAAATACTATGCAGACGCCGTGAAGGGC (SEQ ID NO: 392) | GATTTGGCGATTTTTGGAGTGGTCCCCGACTAC (SEQ ID NO: 393) |
| | AA | NYGMH (SEQ ID NO: 394) | AIWFDASDKYYADAVKG (SEQ ID NO: 395) | DLAIFGVVPDY (SEQ ID NO: 396) |
| 2G10.609 | NA | AACTATGGCATGCAC (SEQ ID NO: 397) | GCTATATGGTTTGATGCAAGTGATAAATACTATGCAGACGCCGTGAAGGGC (SEQ ID NO: 398) | GATTTGGCGATTTTTGGAGTGGTCCCCGACTAC (SEQ ID NO: 399) |
| | AA | NYGMH (SEQ ID NO: 400) | AIWFDASDKYYADAVKG (SEQ ID NO: 401) | DLAIFGVVPDY (SEQ ID NO: 402) |
| 2G10.603 | NA | AACTATGGCATGCAC (SEQ ID NO: 403) | GCTATATGGTTTGATGCAAGTGATAAATACTATGCAGACGCCGTGAAGGGC (SEQ ID NO: 404) | GATTTGGCGATTTTTGGAGTGGTCCCCGACTAC (SEQ ID NO: 405) |
| | AA | NYGMH (SEQ ID NO: 406) | AIWFDASDKYYADAVKG (SEQ ID NO: 407) | DLAIFGVVPDY (SEQ ID NO: 408) |
| 2G10.318 | NA | AACTATGGCATGCAC (SEQ ID NO: 409) | GCTATATGGTTTGATGCAAGTGATAAATACTATGCAGACGCCGTGAAGGGC (SEQ ID NO: 410) | GATTTGGCGATTTTTGGAGTGGTCCCCGACTAC (SEQ ID NO: 411) |
| | AA | NYGMH (SEQ ID NO: 412) | AIWFDASDKYYADAVKG (SEQ ID NO: 413) | DLAIFGVVPDY (SEQ ID NO: 414) |
| 2G10.324 | NA | AACTATGGCATGCAC (SEQ ID NO: 415) | GCTATATGGTTTGATGCAAGTGATAAATACTATGCAGACGCCGTGAAGGGC (SEQ ID NO: 416) | GATTTGGCGATTTTTGGAGTGGTCCCCGACTAC (SEQ ID NO: 417) |
| | AA | NYGMH (SEQ ID NO: 418) | AIWFDASDKYYADAVKG (SEQ ID NO: 419) | DLAIFGVVPDY (SEQ ID NO: 420) |
| 2G10.322 | NA | AACTATGGCATGCAC (SEQ ID NO: 421) | GCTATATGGTTTGATGCAAGTGATAAATACTATGCAGACGCCGTGAAGGGC (SEQ ID NO: 422) | GATTTGGCGATTTTTGGAGTGGTCCCCGACTAC (SEQ ID NO: 423) |
| | AA | NYGMH (SEQ ID NO: 424) | AIWFDASDKYYADAVKG (SEQ ID NO: 425) | DLAIFGVVPDY (SEQ ID NO: 426) |
| 2G10.315 | NA | AACTATGGCATGCAC (SEQ ID NO: 427) | GCTATATGGTTTGATGCAAGTGATAAATACTATGCAGACGCCGTGAAGGGC (SEQ ID NO: 428) | GATTTGGCGATTTTTGGAGTGGTCCCCGACTAC (SEQ ID NO: 429) |
| | AA | NYGMH (SEQ ID NO: 430) | AIWFDASDKYYADAVKG (SEQ ID NO: 431) | DLAIFGVVPDY (SEQ ID NO: 432) |

TABLE 4B-continued

Exemplary CDRH1, CDRH2, and CDRH3 Nucleotide and Amino Acid Sequences

| Ab | Type | CDRH1 | CDRH2 | CDRH3 |
|---|---|---|---|---|
| 2G10.331 | NA | AACTATGGCATGCAC (SEQ ID NO: 433) | GCTATATGGTTTGATGCAAGTGA TAAATACTATGCAGACGCCGTGA AGGGC (SEQ ID NO: 434) | GATTTGGCGATTTTTGGAGTGGT CCCCGACTAC (SEQ ID NO: 435) |
| | AA | NYGMH (SEQ ID NO: 436) | AIWFDASDKYYADAVKG (SEQ ID NO: 437) | DLAIFGVVPDY (SEQ ID NO: 438) |
| 2G10.320 | NA | AACTATGGCATGCAC (SEQ ID NO: 439) | GCTATATGGTTTGATGCAAGTGA TAAATACTATGCAGACGCCGTGA AGGGC (SEQ ID NO: 440) | GATCTGGCGATTTTTGGAGTGAT TCCCGACTAC (SEQ ID NO: 441) |
| | AA | NYGMH (SEQ ID NO: 442) | AIWFDASDKYYADAVKG (SEQ ID NO: 443) | DLAIFGVIPDY (SEQ ID NO: 444) |
| 2G10.328 | NA | AACTATGGCATGCAC (SEQ ID NO: 445) | GCTATATGGTTTGATGCAAGTGA TAAATACTATGCAGACGCCGTGA AGGGC (SEQ ID NO: 446) | GATTTGGCGATTTTTGGAGTGGT CCCCGACTAC (SEQ ID NO: 447) |
| | AA | NYGMH (SEQ ID NO: 448) | AIWFDASDKYYADAVKG (SEQ ID NO: 449) | DLAIFGVVPDY (SEQ ID NO: 450) |
| 2G10.333 | NA | AACTATGGCATGCAC (SEQ ID NO: 451) | GCTATATGGTTTGATGCAAGTGA TAAATACTATGCAGACGCCGTGA AGGGC (SEQ ID NO: 452) | GATTTGGCGATTTTTGGAGTGGT CCCCGACTAC (SEQ ID NO: 453) |
| | AA | NYGMH (SEQ ID NO: 454) | AIWFDASDKYYADAVKG (SEQ ID NO: 455) | DLAIFGVVPDY (SEQ ID NO: 456) |
| 2G10.301 | NA | AACTATGGCATGCAC (SEQ ID NO: 457) | GCTATATGGTTTGATGCGTCTGA CAAATACTATGCAGACGCCGTGA AGGGC (SEQ ID NO: 458) | GATCTTGCGATTTTTGGAGTGGT CCCCGACTAC (SEQ ID NO: 459) |
| | AA | NYGMH (SEQ ID NO: 460) | AIWFDASDKYYADAVKG (SEQ ID NO: 461) | DLAIFGVVPDY (SEQ ID NO: 462) |
| 2G10.601 | NA | AACTATGGCATGCAC (SEQ ID NO: 463) | GCTATATGGTTTGATGCGTCTGA CAAATACTATGCAGACGCCGTGA AGGGC (SEQ ID NO: 464) | GATCTTGCGATTTTTGGAGTGGT CCCCGACTAC (SEQ ID NO: 465) |
| | AA | NYGMH (SEQ ID NO: 466) | AIWFDASDKYYADAVKG (SEQ ID NO: 467) | DLAIFGVVPDY (SEQ ID NO: 468) |
| 2G10.326 | NA | AACTATGGCATGCAC (SEQ ID NO: 469) | GCTATATGGTTTGATGCGTCTGA CAAATACTATGCAGACGCCGTGA AGGGC (SEQ ID NO: 470) | GATCTTGCGATTTTTGGAGTGGT CCCCGACTAC (SEQ ID NO: 471) |
| | AA | NYGMH (SEQ ID NO: 472) | AIWFDASDKYYADAVKG (SEQ ID NO: 473) | DLAIFGVVPDY (SEQ ID NO: 474) |
| 2G10.308 | NA | AACTATGGCATGCAC (SEQ ID NO: 475) | GCTATATGGTTTGATGCAAGTGA TAAATACTATGCAGACGCCGTGA AGGGC (SEQ ID NO: 476) | GATTTGGCGATTTTTGGAGTGGT CCCCGACTAC (SEQ ID NO: 477) |
| | AA | NYGMH (SEQ ID NO: 478) | AIWFDASDKYYADAVKG (SEQ ID NO: 479) | DLAIFGVVPDY (SEQ ID NO: 480) |
| 2G10.608 | NA | AACTATGGCATGCAC (SEQ ID NO: 481) | GCTATATGGTTTGATGCAAGTGA TAAATACTATGCAGACGCCGTGA AGGGC (SEQ ID NO: 482) | GATTTGGCGATTTTTGGAGTGGT CCCCGACTAC (SEQ ID NO: 483) |
| | AA | NYGMH (SEQ ID NO: 484) | AIWFDASDKYYADAVKG (SEQ ID NO: 485) | DLAIFGVVPDY (SEQ ID NO: 486) |

TABLE 4B-continued

Exemplary CDRH1, CDRH2, and CDRH3 Nucleotide and Amino Acid Sequences

| Ab | Type | CDRH1 | CDRH2 | CDRH3 |
|---|---|---|---|---|
| 2G10.336 | NA | AACTATGGCATGCAC (SEQ ID NO: 487) | GCTATATGGTTTGATGCAAGTGATAAATACTATGCAGACGCCGTGAAGGGC (SEQ ID NO: 488) | GATATTGCGATTTTTGGAGTGGTCCCCGACTAC (SEQ ID NO: 489) |
| | AA | NYGMH (SEQ ID NO: 490) | AIWFDASDKYYADAVKG (SEQ ID NO: 491) | DIAIFGVVPDY (SEQ ID NO: 492) |
| 2G10.344 | NA | AACTATGGCATGCAC (SEQ ID NO: 493) | GCTATATGGTTTGATGCAAGTGATAAATACTATGCAGACGCCGTGAAGGGC (SEQ ID NO: 494) | GATATTGCGATTTTTGGAGTGGTCCCCGACTAC (SEQ ID NO: 495) |
| | AA | NYGMH (SEQ ID NO: 496) | AIWFDASDKYYADAVKG (SEQ ID NO: 497) | DIAIFGVVPDY (SEQ ID NO: 498) |
| 2G10.310 | NA | AACTATGGCATGCAC (SEQ ID NO: 499) | GCTATATGGTTTGATGCAAGTGATAAATACTATGCAGACGCCGTGAAGGGC (SEQ ID NO: 500) | GATTTGGCGATTTTTGGAGTGGTCCCCGACTAC (SEQ ID NO: 501) |
| | AA | NYGMH (SEQ ID NO: 502) | AIWFDASDKYYADAVKG (SEQ ID NO: 503) | DLAIFGVVPDY (SEQ ID NO: 504) |
| 2G10.610 | NA | AACTATGGCATGCAC (SEQ ID NO: 505) | GCTATATGGTTTGATGCAAGTGATAAATACTATGCAGACGCCGTGAAGGGC (SEQ ID NO: 506) | GATTTGGCGATTTTTGGAGTGGTCCCCGACTAC (SEQ ID NO: 507) |
| | AA | NYGMH (SEQ ID NO: 508) | AIWFDASDKYYADAVKG (SEQ ID NO: 509) | DLAIFGVVPDY (SEQ ID NO: 510) |
| 2G10.312 | NA | AACTATGGCATGCAC (SEQ ID NO: 511) | GCTATATGGTTTGATGCAAGTGATAAATACTATGCAGACGCCGTGAAGGGC (SEQ ID NO: 512) | GATTTGGCGATTTTTGGAGTGGTCCCCGACTAC (SEQ ID NO: 513) |
| | AA | NYGMH (SEQ ID NO: 514) | AIWFDASDKYYADAVKG (SEQ ID NO: 515) | DLAIFGVVPDY (SEQ ID NO: 516) |
| 2G10.329 | NA | AACTATGGCATGCAC (SEQ ID NO: 517) | GCTATATGGTTTGATGCAAGTGATAAATACTATGCAGACGCCGTGAAGGGC (SEQ ID NO: 518) | GATTTGGCGATTTTTGGAGTGGTCCCCGACTAC (SEQ ID NO: 519) |
| | AA | NYGMH (SEQ ID NO: 520) | AIWFDASDKYYADAVKG (SEQ ID NO: 521) | DLAIFGVVPDY (SEQ ID NO: 522) |
| 2G10.327 | NA | AACTATGGCATGCAC (SEQ ID NO: 523) | GCTATATGGTTTGATGCAAGTGATAAATACTATGCAGACGCCGTGAAGGGC (SEQ ID NO: 524) | GATTTGGCGATTTTTGGAGTGGTCCCCGACTAC (SEQ ID NO: 525) |
| | AA | NYGMH (SEQ ID NO: 526) | AIWFDASDKYYADAVKG (SEQ ID NO: 527) | DLAIFGVVPDY (SEQ ID NO: 528) |
| 2G10.338 | NA | AACTATGGCATGCAC (SEQ ID NO: 529) | GCTATATGGTTTGATGCAAGTGATAAATACTATGCAGACGCCGTGAAGGGC (SEQ ID NO: 530) | GATTTGGCGATTTTTGGAGTGGTCCCCGACTAC (SEQ ID NO: 531) |
| | AA | NYGMH (SEQ ID NO: 532) | AIWFDASDKYYADAVKG (SEQ ID NO: 533) | DLAIFGVVPDY (SEQ ID NO: 534) |
| 2G10.314 | NA | AACTATGGCATGCAC (SEQ ID NO: 535) | GCTATATGGTTTGATGCAAGTGATAAATACTATGCAGACGCCGTGAAGGGC (SEQ ID NO: 536) | GATTTGGCGATTTTTGGAGTGGTCCCCGACTAC (SEQ ID NO: 537) |
| | AA | NYGMH (SEQ ID NO: 538) | AIWFDASDKYYADAVKG (SEQ ID NO: 539) | DLAIFGVVPDY (SEQ ID NO: 540) |

TABLE 4B-continued

Exemplary CDRH1, CDRH2, and CDRH3 Nucleotide and Amino Acid Sequences

| Ab | Type | CDRH1 | CDRH2 | CDRH3 |
|---|---|---|---|---|
| 2G10.337 | NA | AACTATGGCATGCAC (SEQ ID NO: 541) | GCTATATGGTTTGATGCAAGTGA TAAATACTATGCAGACGCCGTGA AGGGC (SEQ ID NO: 542) | GATTTGGCGATTTTTGGAGTGGT CCCCGACTAC (SEQ ID NO: 543) |
| | AA | NYGMH (SEQ ID NO: 544) | AIWFDASDKYYADAVKG (SEQ ID NO: 545) | DLAIFGVVPDY (SEQ ID NO: 546) |
| 2G10.341 | NA | AACTATGGCATGCAC (SEQ ID NO: 547) | GCTATATGGTTTGATGCAAGTGA TAAATACTATGCAGACGCCGTGA AGGGC (SEQ ID NO: 548) | GATTTGGCGATTTTTGGAGTGGT CCCCGACTAC (SEQ ID NO: 549) |
| | AA | NYGMH (SEQ ID NO: 550) | AIWFDASDKYYADAVKG (SEQ ID NO: 551) | DLAIFGVVPDY (SEQ ID NO: 552) |
| 2G10.302 | NA | AACTATGGCATGCAC (SEQ ID NO: 553) | GCTATATGGTTTGATGCAAGTGA TAAATACTATGCAGACGCCGTGA AGGGC (SEQ ID NO: 554) | GATATTGCGATTTTTG- GAGTGTTT CCCGACTAC (SEQ ID NO: 555) |
| | AA | NYGMH (SEQ ID NO: 556) | AIWFDASDKYYADAVKG (SEQ ID NO: 557) | DIAIFGVFPDY (SEQ ID NO: 558) |
| 2G10.602 | NA | AACTATGGCATGCAC (SEQ ID NO: 559) | GCTATATGGTTTGATGCAAGTGA TAAATACTATGCAGACGCCGTGA AGGGC (SEQ ID NO: 560) | GATATTGCGATTTTTG- GAGTGTTT CCCGACTAC (SEQ ID NO: 561) |
| | AA | NYGMH (SEQ ID NO: 562) | AIWFDASDKYYADAVKG (SEQ ID NO: 563) | DIAIFGVFPDY (SEQ ID NO: 564) |
| 2G10.325 | NA | AACTATGGCATGCAC (SEQ ID NO: 565) | GCTATATGGTTTGATGCAAGTGA TAAATACTATGCAGACGCCGTGA AGGGC (SEQ ID NO: 566) | GATATTGCGATTTTTGGAGTGGT CCCCGACTAC (SEQ ID NO: 567) |
| | AA | NYGMH (SEQ ID NO: 568) | AIWFDASDKYYADAVKG (SEQ ID NO: 569) | DIAIFGVVPDY (SEQ ID NO: 570) |
| 2G10.343 | NA | AACTATGGCATGCAC (SEQ ID NO: 571) | GCTATATGGTTTGATGCAAGTGA TAAATACTATGCAGACGCCGTGA AGGGC (SEQ ID NO: 572) | GATATTGCGATTTTTGGAGTGGT CCCCGACTAC (SEQ ID NO: 573) |
| | AA | NYGMH (SEQ ID NO: 574) | AIWFDASDKYYADAVKG (SEQ ID NO: 575) | DIAIFGVVPDY (SEQ ID NO: 576) |
| 2G10.313 | NA | AACTATGGCATGCAC (SEQ ID NO: 577) | GCTATATGGTTTGATGCAAGTGA TAAATACTATGCAGACGCCGTGA AGGGC (SEQ ID NO: 578) | GATATTGCGATTTTTG- GAGTGTTT CCCGACTAC (SEQ ID NO: 579) |
| | AA | NYGMH (SEQ ID NO: 580) | AIWFDASDKYYADAVKG (SEQ ID NO: 581) | DIAIFGVFPDY (SEQ ID NO: 582) |
| 2G10.317 | AA | AACTATGGCATGCAC (SEQ ID NO: 583) | GCTATATGGTTTGATGCAAGTGA TAAATACTATGCAGACGCCGTGA AGGGC (SEQ ID NO: 584) | GATATTGCGATTTTTG- GAGTGTTT CCCGACTAC (SEQ ID NO: 585) |
| | AA | NYGMH (SEQ ID NO: 586) | AIWFDASDKYYADAVKG (SEQ ID NO: 587) | DIAIFGVFPDY (SEQ ID NO: 588) |
| 2G10.311 | NA | AACTATGGCATGCAC (SEQ ID NO: 589) | GCTATATGGTTTGATGCAAGTGA TAAATACTATGCAGACGCCGTGA AGGGC (SEQ ID NO: 590) | GATATTGCGATTTTTG- GAGTGTTT CCCGACTAC (SEQ ID NO: 591) |

TABLE 4B-continued

| Exemplary CDRH1, CDRH2, and CDRH3 Nucleotide and Amino Acid Sequences | | | | |
|---|---|---|---|---|
| Ab | Type | CDRH1 | CDRH2 | CDRH3 |
| | AA | NYGMH (SEQ ID NO: 592) | AIWFDASDKYYADAVKG (SEQ ID NO: 593) | DIAIFGVFPDY (SEQ ID NO: 594) |
| 2G10.306 | NA | AACTATGGCATGCAC (SEQ ID NO: 595) | GCTATATGGTTTGATGCAAGTGA TAAATACTATGCAGACGCCGTGA AGGGC (SEQ ID NO: 596) | GATATTGCGATTTTTGGAGTGAT CCCCGACTAC (SEQ ID NO: 597) |
| | AA | NYGMH (SEQ ID NO: 598) | AIWFDASDKYYADAVKG (SEQ ID NO: 599) | DIAIFGVIPDY (SEQ ID NO: 600) |
| 2G10.606 | NA | AACTATGGCATGCAC (SEQ ID NO: 601) | GCTATATGGTTTGATGCAAGTGA TAAATACTATGCAGACGCCGTGA AGGGC (SEQ ID NO: 602) | GATATTGCGATTTTTGGAGTGAT CCCCGACTAC (SEQ ID NO: 603) |
| | AA | NYGMH (SEQ ID NO: 604) | AIWFDASDKYYADAVKG (SEQ ID NO: 605) | DIAIFGVIPDY (SEQ ID NO: 606) |
| 2G10.347 | NA | AACTATGGCATGCAC (SEQ ID NO: 607) | GCTATATGGTTTGATGCAAGTGA TAAATACTATGCAGACGCCGTGA AGGGC (SEQ ID NO: 608) | GATTTGGCGATTTTTGGAGTGGT CCCCGACTAC (SEQ ID NO: 609) |
| | AA | NYGMH (SEQ ID NO: 610) | AIWFDASDKYYADAVKG (SEQ ID NO: 611) | DLAIFGVVPDY (SEQ ID NO: 612) |
| SG10.348 | NA | AACTATGGCATGCAC (SEQ ID NO: 613) | GCTATATGGTTTGATGCAAGTGA TAAATACTATGCAGACGCCGTGA AGGGC (SEQ ID NO: 614) | GATCAGGCGATTTTTGGAGTGGT CCCCGATTAC (SEQ ID NO: 615) |
| | AA | NYGMH (SEQ ID NO: 616) | AIWFDASDKYYADAVKG (SEQ ID NO: 617) | DQAIFGVVPDY (SEQ ID NO: 618) |
| 2G10.346 | NA | AACTATGGCATGCAC (SEQ ID NO: 619) | GCTATATGGTTTGATGCAAGTGA TAAATACTATGCAGACGCCGTGA AGGGC (SEQ ID NO: 620) | GATATTGCGATTTTTGGAGTGGT CCCCGACTAC (SEQ ID NO: 621) |
| | AA | NYGMH (SEQ ID NO: 622) | AIWFDASDKYYADAVKG (SEQ ID NO: 623) | DIAIFGVVPDY (SEQ ID NO: 624) |
| 2G10.647 | NA | AACTATGGCATGCAC (SEQ ID NO: 625) | GCTATATGGTTTGATGCAAGTGA TAAATACTATGCAGACGCCGTGA AGGGC (SEQ ID NO: 626) | GATTTGGCGATTTTTGGAGTGGT CCCCGACTAC (SEQ ID NO: 627) |
| | AA | NYGMH (SEQ ID NO: 628) | AIWFDASDKYYADAVKG (SEQ ID NO: 629) | DLAIFGVVPDY (SEQ ID NO: 630) |
| 2G10.649 | NA | AACTATGGCATGCAC (SEQ ID NO: 631) | GCTATATGGTTTGATGCAAGTGA TAAATACTATGCAGACGCCGTGA AGGGC (SEQ ID NO: 632) | GATCAGGCGATTTTTGGAGTGGT CCCCGATTAC (SEQ ID NO: 633) |
| | AA | NYGMH (SEQ ID NO: 634) | AIWFDASDKYYADAVKG (SEQ ID NO: 635) | DQAIFGVVPDY (SEQ ID NO: 636) |
| 2G10.305 | NA | AACTATGGCATGCAC (SEQ ID NO: 637) | GCTATATGGTTTGATGCAAGTGA TAAATACTATGCAGACGCCGTGA AGGGC (SEQ ID NO: 638) | GATTTGGCGATTTTTGGAGTGGT CCCCGACTAC (SEQ ID NO: 639) |
| | AA | NYGMH (SEQ ID NO: 640) | AIWFDASDKYYADAVKG (SEQ ID NO: 641) | DLAIFGVVPDY (SEQ ID NO: 642) |
| 2G10.605 | NA | AACTATGGCATGCAC (SEQ ID NO: 643) | GCTATATGGTTTGATGCAAGTGA TAAATACTATGCAGACGCCGTGA AGGGC (SEQ ID NO: 644) | GATTTGGCGATTTTTGGAGTGGT CCCCGACTAC (SEQ ID NO: 645) |
| | AA | NYGMH (SEQ ID NO: 646) | AIWFDASDKYYADAVKG (SEQ ID NO: 647) | DLAIFGVVPDY (SEQ ID NO: 648) |

TABLE 4B-continued

Exemplary CDRH1, CDRH2, and CDRH3 Nucleotide and Amino Acid Sequences

| Ab | Type | CDRH1 | CDRH2 | CDRH3 |
|---|---|---|---|---|
| 2G10.340 | NA | AACTATGGCATGCAC (SEQ ID NO: 649) | GCTATATGGTTTGATGCAAGTGA TAAATACTATGCAGACGCCGTGA AGGGC (SEQ ID NO: 650) | GATATTGCGATTTTTGGAGTGGT CCCCGACTAC (SEQ ID NO: 651) |
| | AA | NYGMH (SEQ ID NO: 652) | AIWFDASDKYYADAVKG (SEQ ID NO: 653) | DIAIFGVVPDY (SEQ ID NO: 654) |
| 2G10.334 | NA | AACTATGGCATGCAC (SEQ ID NO: 655) | GCTATATGGTTTGATGCAAGTGA TAAATACTATGCAGACGCCGTGA AGGGC (SEQ ID NO: 656) | GATTTGGCGATTTTTGGAGTGGT CCCCGACTAC (SEQ ID NO: 657) |
| | AA | NYGMH (SEQ ID NO: 658) | AIWFDASDKYYADAVKG (SEQ ID NO: 659) | DLAIFGVVPDY (SEQ ID NO: 660) |
| 2G10.339 | NA | AACTATGGCATGCAC (SEQ ID NO: 661) | GCTATATGGTTTGATGCAAGTGA TAAATACTATGCAGACGCCGTGA AGGGC (SEQ ID NO: 662) | GATATTGCGATTTTTGGAGTGGT CCCCGACTAC (SEQ ID NO: 663) |
| | AA | NYGMH (SEQ ID NO: 664) | AIWFDASDKYYADAVKG (SEQ ID NO: 665) | DIAIFGVVPDY (SEQ ID NO: 666) |
| 2G10.307 | NA | AACTATGGCATGCAC (SEQ ID NO: 667) | GCTATATGGTTTGATGCGTACGG TAAATACTATGCAGACGCCGTGA AGGGC (SEQ ID NO: 668) | GATCAGACGATTTTTGGAGTGGT CCCCGACTAC (SEQ ID NO: 669) |
| | AA | NYGMH (SEQ ID NO: 670) | AIWFDAYGKYYADAVKG (SEQ ID NO: 671) | DQTIFGVVPDY (SEQ ID NO: 672) |
| 2G10.607 | NA | AACTATGGCATGCAC (SEQ ID NO: 673) | GCTATATGGTTTGATGCGTACGG TAAATACTATGCAGACGCCGTGA AGGGC (SEQ ID NO: 674) | GATCAGACGATTTTTGGAGTGGT CCCCGACTAC (SEQ ID NO: 675) |
| | AA | NYGMH (SEQ ID NO: 676) | AIWFDAYGKYYADAVKG (SEQ ID NO: 677) | DQTIFGVVPDY (SEQ ID NO: 678) |
| 2G10.321 | NA | AACTATGGCATGCAC (SEQ ID NO: 679) | GCTATATGGTTTGATGCGTACGG TAAATACTATGCAGACGCCGTGA (SEQ ID NO: 680) | GATAAGACGATTTTTGGAGTGGT CCCCGACTAC AGGGC (SEQ ID NO: 681) |
| | AA | NYGMH (SEQ ID NO: 682) | AIWFDAYGKYYADAVKG (SEQ ID NO: 683) | DKTIFGVVPDY (SEQ ID NO: 684) |
| 2G10.342 | NA | AACTATGGCATGCAC (SEQ ID NO: 685) | GCTATATGGTTTGATGCGTACGG TAAATACTATGCAGACGCCGTGA AGGGC (SEQ ID NO: 686) | GATAAGACGATTTTTGGAGTGGT CCCCGACTAC (SEQ ID NO: 687) |
| | AA | NYGMH (SEQ ID NO: 688) | AIWFDAYGKYYADAVKG (SEQ ID NO: 689) | DKTIFGVVPDY (SEQ ID NO: 690) |
| 2G10.319 | NA | AACTATGGCATGCAC (SEQ ID NO: 691) | GCTATATGGTTTGATGCGTACGG TAAATACTATGCAGACGCCGTGA AGGGC (SEQ ID NO: 692) | GATAAGACGATTTTTGGAGTGGT CCCCGACTAC (SEQ ID NO: 693) |
| | AA | NYGMH (SEQ ID NO: 694) | AIWFDAYGKYYADAVKG (SEQ ID NO: 695) | DKTIFGVVPDY (SEQ ID NO: 696) |
| 2G10.332 | NA | AACTATGGCATGCAC (SEQ ID NO: 697) | GCTATATGGTTTGATGCGTACGA CAAATACTATGCAGACGCCGTGA AGGGC (SEQ ID NO: 698) | GATAAGTCGATTTTTGGAGTGGT CCCCGACTAC (SEQ ID NO: 699) |
| | AA | NYGMH (SEQ ID NO: 700) | AIWFDAYDKYYADAVKG (SEQ ID NO: 701) | DKSIFGVVPDY (SEQ ID NO: 702) |
| 2G10.345 | NA | AACTATGGCATGCAC (SEQ ID NO: 703) | GCTATATGGTTTGATGCGTACGA CAAATACTATGCAGACGCCGTGA AGGGC (SEQ ID NO: 704) | GATAAGTCGATTTTTGGAGTGGT CCCCGACTAC (SEQ ID NO: 705) |

TABLE 4B-continued

| Exemplary CDRH1, CDRH2, and CDRH3 Nucleotide and Amino Acid Sequences | | | | |
|---|---|---|---|---|
| Ab | Type | CDRH1 | CDRH2 | CDRH3 |
| | AA | NYGMH (SEQ ID NO: 706) | AIWFDAYDKYYADAVKG (SEQ ID NO: 707) | DKSIFGVVPDY (SEQ ID NO: 708) |
| 2G10.335 | NA | AACTATGGCATGCAC (SEQ ID NO: 709) | GCTATATGGTTTGATGCGTACGA CAAATACTATGCAGACGCCGTGA AGGGC (SEQ ID NO: 710) | GATCTCGCGATTTTTGGAGTGGT CCCCGACTAC (SEQ ID NO: 711) |
| | AA | NYGMH (SEQ ID NO: 712) | AIWFDAYDKYYADAVKG (SEQ ID NO: 713) | DLAIFGVVPDY (SEQ ID NO: 714) |
| 2G10.330 | NA | AACTATGGCATGCAC (SEQ ID NO: 715) | GCTATATGGTTTGATGCGGCTTT CAAATACTATGCAGACGCCGTGA AGGGC (SEQ ID NO: 716) | GATCTCGCGATTTTTGGAGTGGT CCCCGACTAC (SEQ ID NO: 717) |
| | AA | NYGMH (SEQ ID NO: 718) | AIWFDAAFKYYADAVKG (SEQ ID NO: 719) | DLAIFGVVPDY (SEQ ID NO: 720) |
| iPS: 529381 | AA | NYGMH (SEQ ID NO: 1293) | AIWFDASDKYYADAVKG (SEQ ID NO: 1294) | DLAIFGVIPDY (SEQ ID NO: 1295) |
| iPS: 529382 | AA | NYGMH (SEQ ID NO: 1303) | AIWFDASDKYYADAVKG (SEQ ID NO: 1304) | DIAIFGVVPDY (SEQ ID NO: 1305) |
| iPS: 529397 | AA | NYGMH (SEQ ID NO: 1313) | AIWFDASDKYYADAVKG (SEQ ID NO: 1314) | DQAIFGVVPDY (SEQ ID NO: 1315) |
| iPS: 529399 | AA | NYGMH (SEQ ID NO: 1323) | AIWFDASDKYYADAVKG (SEQ ID NO: 1324) | DLAIFGVIPDY (SEQ ID NO: 1325) |
| iPS: 529400 | AA | NYGMH (SEQ ID NO: 1333) | AIWFDASDKYYADAVKG (SEQ ID NO: 1334) | DIAIFGVVPDY (SEQ ID NO: 1335) |
| iPS: 529403 | AA | NYGMH (SEQ ID NO: 1343) | AIWFDASDKYYADAVKG (SEQ ID NO: 1344) | DLAIFGVVPDY (SEQ ID NO: 1345) |
| iPS: 529404 | AA | NYGMH (SEQ ID NO: 1353) | AIWFDASDKYYADAVKG (SEQ ID NO: 1354) | DLAIFGVVPDY (SEQ ID NO: 1355) |
| iPS: 529405 | AA | NYGMH (SEQ ID NO: 1363) | AIWFDASDKYYADAVKG (SEQ ID NO: 1364) | DLAIFGVVPDY (SEQ ID NO: 1365) |

TABLE 5

| Exemplary Light and Heavy Chain Nucleic Acid (“NA”) and Amino Acid (“AA”) Sequences | | | | |
|---|---|---|---|---|
| Ab | Description | Type | LC | HC |
| 2G10.303 | [hu anti- <huGIPR> 2G10.303 VK3 (1-236) VL]::huKLC -CL + [Unknown anti- <huGIPR> 2G10.610 VH3 (1-472) VH]::huIgG1 zSEFL2-2 (mAb); LMR ID: SS- 26180 | NA | GAAATAGTGATGACGCAGTCT CCAGCCACCCTGTCTGTGTCT CCAGGGGAAAGAGCCACCCT CTCCTGCAGGGCCAGTCAGAG TGTTGATAGACACTTAGCCTG GTACCAGCAGAAACCTGGCC AGGCTCCCAGGCTCCTCATCT ACGAAGCAGCCACCAGGGCC ACTGGTATCCCAGCCAGGTTC AGTGGCAGTGGGTCTGGGAC AGAGTTCACTCTCACCATCAG CAGCCTGCAGTCTGAAGATTT TGCAGTTTATTACTGTCAGCA GTATCAGAACTGGCCTCTCAC TTTCGGCGGAGGGACCAAGGT GGAGATCAAACGAACGGTGG CTGCACCATCTGTCTTCATCTT CCCGCCATCTGATGAGCAGTT GAAATCTGGAACTGCCTCTGT TGTGTGCCTGCTGAATAACTT CTATCCCAGAGAGGCCAAAG TACAGTGGAAGGTGGATAAC GCCCTCCAATCGGGTAACTCC | CAGGTGCAGCTGGTGGAGTCTGGGGGAGGCGTGGTCCAGCC TGGGAGGTCCCTGAGACTCTCCTGTGCAGCATCTGGATTCA CCTTCAGTAACTATGGCATGCACTGGGTCCGCCAGGCTCCA GGCGAGGGGCTGGAGTGGGTGGCAGCTATATGGTTTGATGC AAGTGATAAATACTATGCAGACGCCGTGAAGGGCCGATTCA CCATCTCCAGAGACAACTCCAAGAACACGCTGTATCTGCAA ATGAACAGCCTGAGAGCCGAGGACACGGCTGTGTATTACTG TGCGAGAGATTTGGCGATTTTTGGAGTGGTCCCCGACTACT GGGGCCAGGGAACCCTGGTCACCGTGTCTAGTGCCTCCACC AAGGGCCCATCGGTCTTCCCCCTGGCACCCTCCTCCAAGAG CACCTCTGGGGGCACAGCGGCCCTGGGCTGCCTGGTCAAGG ACTACTTCCCCGAACCGGTGACGGTGTCGTGGAACTCAGGC GCCCTGACCAGCGGCGTGCACACCTTCCCGGCTGTCCTACA GTCCTCAGGACTCTACTCCCTCAGCAGCGTGGTGACCGTGC CCTCCAGCAGCTTGGGCACCCAGACCTACATCTGCAACGTG AATCACAAGCCCAGCAACACCAAGGTGGACAAGAAAGTTG AGCCCAAATCTTGTGACAAAACTCACACATGCCCACCGTGC CCAGCACCTGAACTCCTGGGGGGACCGTCAGTCTTCCTCTTC CCCCCAAAACCCAAGGACACCCTCATGATCTCCCGGACCCC TGAGGTCACATGCGTGGTGGTGGACGTGAGCCACGAAGACC CTGAGGTCAAGTTCAACTGGTACGTGGACGGCGTGGAGGTG CATAATGCCAAGACAAAGCCGTGCGAGGAGCAGTACGGCA GCACGTACCGTTGCGTCAGCGTCCTCACCGTCCTGCACCAG |

TABLE 5-continued

| Exemplary Light and Heavy Chain Nucleic Acid ("NA") and Amino Acid ("AA") Sequences | | | | |
|---|---|---|---|---|
| Ab | Description | Type | LC | HC |
| | | | CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 12) | GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 13) |
| | | AA | EIVMTQSPATLSVSPGERATLS<br>CRASQSVDRHLAWYQQKPGQ<br>APRLLIYEAATRATGIPARFSGS<br>GSGTEFTLTISSLQSEDFAVYYC<br>QQYQNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 14) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 15) |
| 2G10.304 | [hu anti-<br><huGIPR><br>2G10.304<br>VK3 1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb), LMR<br>ID: SS-<br>26181 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTAACAGACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 16) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 17) |
| | | AA | EIVMTQSPATLSVSPGERATLS<br>CRASQSVNRHLAWYQQKPGQ<br>APRLLIYEAATRATGIPARFSGS<br>GSGTEFTLTISSLQSEDFAVYYC<br>QQYQNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 18) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 19) |

TABLE 5-continued

Exemplary Light and Heavy Chain Nucleic Acid ("NA") and Amino Acid ("AA") Sequences

| Ab | Description | Type | LC | HC |
|---|---|---|---|---|
| 2G10.323 | [hu anti-<huGIPR> 2G10.323 VK3 (1-236) VL]::huKLC-CL + [Unknown anti-<huGIPR> 2G10.610 VH3 (1-472) VH]::huIgG1 zSEFL2-2 (mAb); LMR ID: SS-26200 | NA | GAAATAGTGATGACGCAGTCTCCAGCCACCCTGTCTGTGTCTCCAGGGGAAAGAGCCACCCTCTCCTGCAGGGCCAGTCAGAGTGTTCATAGACACTTAGCCTGGTACCAGCAGAAACCTGGCCAGGCTCCCAGGCTCCTCATCTACGAAGCAGCCACCAGGGCCACTGGTATCCCAGCCAGGTTCAGTGGCAGTGGGTCTGGGACAGAGTTCACTCTCACCATCAGCAGCCTGCAGTCTGAAGATTTTGCAGTTTATTACTGTCAGCAGTATCAGAACTGGCCTCTCACTTTCGGCGGAGGGACCAAGGTGGAGATCAAACGAACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGT (SEQ ID NO: 20) | CAGGTGCAGCTGGTGGAGTCTGGGGGAGGCGTGGTCCAGCCTGGGAGGTCCCTGAGACTCTCCTGTGCAGCATCTGGATTCACCTTCAGTAACTATGGCATGCACTGGGTCCGCCAGGCTCCAGGCGAGGGGCTGGAGTGGGTGGCAGCTATATGGTTTGATGCAAGTGATAAATACTATGCAGACGCCGTGAAGGGCCGATTCACCATCTCCAGAGACAACTCCAAGAACACGCTGTATCTGCAAATGAACAGCCTGAGAGCCGAGGACACGGCTGTGTATTACTGTGCGAGAGATTTGGCGATTTTTGGAGTGGTCCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA (SEQ ID NO: 21) |
| | | AA | EIVMTQSPATLSVSPGERATLSCRASQSVHRHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 22) | QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 23) |
| 2G10.309 | [hu anti-<huGIPR> 2G10.309 VK3 (1-236) VL]::huKLC-CL + [Unknown anti-<huGIPR> 2G10.610 VH3 (1-472) VH]::huIgG1 zSEFL2-2 (mAb), LMR ID: SS-26186 | NA | GAAATAGTGATGACGCAGTCTCCAGCCACCCTGTCTGTGTCTCCAGGGGAAAGAGCCACCCTCTCCTGCAGGGCCAGTCAGAGTGTTGAAAGACACTTAGCCTGGTACCAGCAGAAACCTGGCCAGGCTCCCAGGCTCCTCATCTACGAAGCAGCCACCAGGGCCACTGGTATCCCAGCCAGGTTCAGTGGCAGTGGGTCTGGGACAGAGTTCACTCTCACCATCAGCAGCCTGCAGTCTGAAGATTTTGCAGTTTATTACTGTCAGCAGTATCAGAACTGGCCTCTCACTTTCGGCGGAGGGACCAAGGTGGAGATCAAACGAACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGA | CAGGTGCAGCTGGTGGAGTCTGGGGGAGGCGTGGTCCAGCCTGGGAGGTCCCTGAGACTCTCCTGTGCAGCATCTGGATTCACCTTCAGTAACTATGGCATGCACTGGGTCCGCCAGGCTCCAGGCGAGGGGCTGGAGTGGGTGGCAGCTATATGGTTTGATGCAAGTGATAAATACTATGCAGACGCCGTGAAGGGCCGATTCACCATCTCCAGAGACAACTCCAAGAACACGCTGTATCTGCAAATGAACAGCCTGAGAGCCGAGGACACGGCTGTGTATTACTGTGCGAGAGATTTGGCGATTTTTGGAGTGGTCCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCC |

TABLE 5-continued

Exemplary Light and Heavy Chain Nucleic Acid ("NA") and Amino Acid ("AA") Sequences

| Ab | Description | Type | LC | HC |
|---|---|---|---|---|
| | | | CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 24) | CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 25) |
| | | AA | EIVMTQSPATLSVSPGERATLS<br>CRASQSVERHLAWYQQKPGQ<br>APRLLIYEAATRATGIPARFSGS<br>GSGTEFTLTISSLQSEDFAVYYC<br>QQYQNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 26) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 27) |
| 2G10.316 | [hu anti-<br><huGIPR><br>2G10.316<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26193 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTTTCAGACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 28) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 29) |
| | | AA | EIVMTQSPATLSVSPGERATLS<br>CRASQSVFRHLAWYQQKPGQA<br>PRLLIYEAATRATGIPARFSGSG<br>SGTEFTLTISSLQSEDFAVYYCQ<br>QYQNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 30) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 31) |

TABLE 5-continued

Exemplary Light and Heavy Chain Nucleic Acid ("NA") and Amino Acid ("AA") Sequences

| Ab | Description | Type | LC | HC |
|---|---|---|---|---|
| 2G10.604 | [hu anti-<br><huGIPR><br>2G10.604<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26229 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTAACAGACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGGTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 32) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 33) |
| | | AA | EIVMTQSPATLSVSPGERATLS<br>CRASQSVNRHLAWYQQKPGQ<br>APRLLIYEAATRATGIPARVSGS<br>GSGTEFTLTISSLQSEDFAVYYC<br>QQYQNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 34) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 35) |
| 2G10.609 | [hu anti-<br><huGIPR><br>2G10.609<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26234 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTGAAAGACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGGTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC |

TABLE 5-continued

| Exemplary Light and Heavy Chain Nucleic Acid ("NA") and Amino Acid ("AA") Sequences | | | | |
|---|---|---|---|---|
| Ab | Description | Type | LC | HC |
| | | | CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 36) | CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 37) |
| | | AA | EIVMTQSPATLSVSPGERATLS<br>CRASQSVERHLAWYQQKPGQ<br>APRLLIYEAATRATGIPARVSGS<br>GSGTEFTLTISSLQSEDFAVYYC<br>QQYQNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 38) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 39) |
| 2G10.603 | [hu anti-<br><huGIPR><br>2G10.603<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26228 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTGATAGACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGGTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 40) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 41) |
| | | AA | EIVMTQSPATLSVSPGERATLS<br>CRASQSVDRHLAWYQQKPGQ<br>APRLLIYEAATRATGIPARVSGS<br>GSGTEFTLTISSLQSEDFAVYYC<br>QQYQNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 42) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 43) |

TABLE 5-continued

Exemplary Light and Heavy Chain Nucleic Acid ("NA") and Amino Acid ("AA") Sequences

| Ab | Description | Type | LC | HC |
|---|---|---|---|---|
| 2G10.318 | [hu anti-<huGIPR> 2G10.318 VK3 (1-236) VL]::huKLC -CL + [Unknown anti-<huGIPR> 2G10.610 VH3 (1-472) VH]::huIgG1 zSEFL2-2 (mAb); LMR ID: SS-26195 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTCTGAGTCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 44) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 45) |
| | | AA | EIVMTQSPATLSVSPGERATLS<br>CRASQSVLSHLAWYQQKPGQA<br>PRLLIYEAATRATGIPARFSGSG<br>SGTEFTLTISSLQSEDFAVYYCQ<br>QYNNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 46) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 47) |
| 2G10.324 | [hu anti-<huGIPR> 2G10.324 VK3 (1-236) VL]::huKLC -CL + [Unknown anti-<huGIPR> 2G10.610 VH3 (1-472) VH]::huIgG1 zSEFL2-2 (mAb); LMR ID: SS-26201 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTCTGAGTCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC |

TABLE 5-continued

Exemplary Light and Heavy Chain Nucleic Acid ("NA") and Amino Acid ("AA") Sequences

| Ab | Description | Type | LC | HC |
|---|---|---|---|---|
| | | | CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 48) | CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 49) |
| | | AA | EIVMTQSPATLSVSPGERATLS<br>CRASQSVLSHLAWYQQKPGQA<br>PRLLIYEAATRATGIPARFSGSG<br>SGTEFTLTISSLQSEDFAVYYCQ<br>QYQNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 50) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 51) |
| 2G10.322 | [hu anti-<br><huGIPR><br>2G10.322<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26199 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTATGAGTCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 52) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 53) |
| | | AA | EIVMTQSPATLSVSPGERATLS<br>CRASQSVMSHLAWYQQKPGQ<br>APRLLIYEAATRATGIPARFSGS<br>GSGTEFTLTISSLQSEDFAVYYC<br>QQYQNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 54) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 55) |

TABLE 5-continued

| Exemplary Light and Heavy Chain Nucleic Acid ("NA") and Amino Acid ("AA") Sequences | | | | |
|---|---|---|---|---|
| Ab | Description | Type | LC | HC |
| 2G10.315 | [hu anti-<br><huGIPR><br>2G10.306<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26192 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTCTGACGCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 56) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 57) |
| | | AA | EIVMTQSPATLSVSPGERATLS<br>CRASQSVLTHLAWYQQKPGQA<br>PRLLIYEAATRATGIPARFSGSG<br>SGTEFTLTISSLQSEDFAVYYCQ<br>QYQNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 58) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 59) |
| 2G10.331 | [hu anti-<br><huGIPR><br>2G10.331<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26208 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTGATCTGCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC |

TABLE 5-continued

Exemplary Light and Heavy Chain Nucleic Acid ("NA") and Amino Acid ("AA") Sequences

| Ab | Description | Type | LC | HC |
|---|---|---|---|---|
| | | | CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 60) | CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 61) |
| | | AA | EIVMTQSPATLSVSPGERATLS<br>CRASQSVDLHLAWYQQKPGQ<br>APRLLIYEAATRATGIPARFSGS<br>GSGTEFTLTISSLQSEDFAVYYC<br>QQYQNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 62) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 63) |
| 2G10.320 | [hu anti-<br><huGIPR><br>2G10.320<br>VK3 (1-236)<br>VL]::huKLC<br>-CL + [hu<br>anti-<br><huGIPR><br>2G10.320<br>VH3 (1-472)<br>VH]::huIgG1<br>zSEFL2-2<br>(mAb); LMR<br>ID: SS-<br>26197 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTAGCGAACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 64) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATCTGGCGATTTTTGGAGTGATTCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 65) |
| | | AA | EIVMTQSPATLSVSPGERATLS<br>CRASQSVSEHLAWYQQKPGQA<br>PRLLIYEAATRATGIPARFSGSG<br>SGTEFTLTISSLQSEDFAVYYCQ<br>QYQNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 66) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVIPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 67) |

TABLE 5-continued

Exemplary Light and Heavy Chain Nucleic Acid ("NA") and Amino Acid ("AA") Sequences

| Ab | Description | Type | LC | HC |
|---|---|---|---|---|
| 2G10.328 | [hu anti-<br><huGIPR><br>2G10.320<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26205 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTAGCGAACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 68) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 69) |
| | | AA | EIVMTQSPATLSVSPGERATLS<br>CRASQSVSEHLAWYQQKPGQA<br>PRLLIYEAATRATGIPARFSGSG<br>SGTEFTLTISSLQSEDFAVYYCQ<br>QYQNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 70) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 71) |
| 2G10.333 | [hu anti-<br><huGIPR><br>2G10.333<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26210 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTAGCCGGCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGCACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC |

TABLE 5-continued

| Ab | Description | Type | LC | HC |
|---|---|---|---|---|
| Exemplary Light and Heavy Chain Nucleic Acid ("NA") and Amino Acid ("AA") Sequences | | | | |
| | | | CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 72) | CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 73) |
| | | AA | EIVMTQSPATLSVSPGERATLS<br>CRASQSVSRHLAWYQQKPGQA<br>PRLLIYEAATRATGIPARFSGSG<br>SGTEFTLTISSLQSEDFAVYYCQ<br>QYQHWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 74) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 75) |
| 2G10.301 | [hu anti-<br><huGIPR><br>2G10.301<br>VK3 (1-236)<br>VL]::huKLC<br>-CL + [hu<br>anti-<br><huGIPR><br>2G10.301<br>VH3 (1-472)<br>VH]::huIgG1<br>zSEFL2-2<br>(mAb); LMR<br>ID: SS-<br>26178 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTTTCAGCCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 76) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCCAGAACTATGGCATGCACTGGGTCCGCCAGGCTCCA<br>GGCGAGGGGCTGGAGTGGGTGGCAGCTATATGGTTTGATGC<br>GTCTGACAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATCTTGCGATTTTTGGAGTGGTCCCCGACTACTG<br>GGGCCAGGGAACCCTGGTCACCGTGTCTAGTGCCTCCACCA<br>AGGGCCCATCGGTCTTCCCCCTGGCACCCTCCTCCAAGAGC<br>ACCTCTGGGGGCACAGCGGCCCTGGGCTGCCTGGTCAAGGA<br>CTACTTCCCCGAACCGGTGACGGTGTCGTGGAACTCAGGCG<br>CCCTGACCAGCGGCGTGCACACCTTCCCGGCTGTCCTACAG<br>TCCTCAGGACTCTACTCCCTCAGCAGCGTGGTGACCGTGCCC<br>TCCAGCAGCTTGGGCACCCAGACCTACATCTGCAACGTGAA<br>TCACAAGCCCAGCAACACCAAGGTGGACAAGAAAGTTGAG<br>CCCAAATCTTGTGACAAAACTCACACATGCCCACCGTGCCC<br>AGCACCTGAACTCCTGGGGGGACCGTCAGTCTTCCTCTTCCC<br>CCCAAAACCCAAGGACACCCTCATGATCTCCCGGACCCCTG<br>AGGTCACATGCGTGGTGGTGGACGTGAGCCACGAAGACCCT<br>GAGGTCAAGTTCAACTGGTACGTGGACGGCGTGGAGGTGCA<br>TAATGCCAAGACAAAGCCGTGCGAGGAGCAGTACGGCAGC<br>ACGTACCGTTGCGTCAGCGTCCTCACCGTCCTGCACCAGGA<br>CTGGCTGAATGGCAAGGAGTACAAGTGCAAGGTGTCCAACA<br>AAGCCCTCCCAGCCCCCATCGAGAAAACCATCTCCAAAGCC<br>AAAGGGCAGCCCCGAGAACCACAGGTGTACACCCTGCCCCC<br>ATCCCGGGAGGAGATGACCAAGAACCAGGTCAGCCTGACCT<br>GCCTGGTCAAAGGCTTCTATCCCAGCGACATCGCCGTGGAG<br>TGGGAGAGCAATGGGCAGCCGGAGAACAACTACAAGACCA<br>CGCCTCCCGTGCTGGACTCCGACGGCTCCTTCTTCCTCTATA<br>GCAAGCTCACCGTGGACAAGAGCAGGTGGCAGCAGGGGAA<br>CGTCTTCTCATGCTCCGTGATGCATGAGGCTCTGCACAACCA<br>CTACACGCAGAAGAGCCTCTCCCTGTCTCCGGGTAAA<br>(SEQ ID NO: 77) |
| | | AA | EIVMTQSPATLSVSPGERATLS<br>CRASQSVFSHLAWYQQKPGQA<br>PRLLIYEAATRATGIPARFSGSG<br>SGTEFTLTISSLQSEDFAVYYCQ<br>QYQNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 78) | QVQLVESGGGVVQPGRSLRLSCAASGFTFQNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 79) |
| 2G10.601 | [hu anti-<br><huGIPR><br>2G10.601<br>VK3 (1-236)<br>VL]::huKLC | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTTTCAGCCACTTAGCCTG | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCCAGAACTATGGCATGCACTGGGTCCGCCAGGCTCCA<br>GGCGAGGGGCTGGAGTGGGTGGCAGCTATATGGTTTGATGC<br>GTCTGACAAATACTATGCAGACGCCGTGAAGGGCCGATTCA |

TABLE 5-continued

Exemplary Light and Heavy Chain Nucleic Acid ("NA") and Amino Acid ("AA") Sequences

| Ab | Description | Type | LC | HC |
|---|---|---|---|---|
| | -CL + [hu<br>anti-<br><huGIPR><br>2G10.301<br>VH3 (1-472)<br>VH]::huIgG1<br>zSEFL2-2<br>(mAb); LMR<br>ID: SS-<br>26226 | | GTACCAGCAGAAACCTGGCC<br>AGGCTCCCAGGCTCCTCATCT<br>ACGAAGCAGCCACCAGGGCC<br>ACTGGTATCCCAGCCAGGGTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 80) | CCATCTCCAGAGACAACTCCAAGAACACGCTGTATCTGCAA<br>ATGAACAGCCTGAGAGCCGAGGACACGGCTGTGTATTACTG<br>TGCGAGAGATCTTGCGATTTTTGGAGTGGTCCCCGACTACTG<br>GGGCCAGGGAACCCTGGTCACCGTGTCTAGTGCCTCCACCA<br>AGGGCCCATCGGTCTTCCCCCTGGCACCCTCCTCCAAGAGC<br>ACCTCTGGGGGCACAGCGGCCCTGGGCTGCCTGGTCAAGGA<br>CTACTTCCCCGAACCGGTGACGGTGTCGTGGAACTCAGGCG<br>CCCTGACCAGCGGCGTGCACACCTTCCCGGCTGTCCTACAG<br>TCCTCAGGACTCTACTCCCTCAGCAGCGTGGTGACCGTGCCC<br>TCCAGCAGCTTGGGCACCCAGACCTACATCTGCAACGTGAA<br>TCACAAGCCCAGCAACACCAAGGTGGACAAGAAAGTTGAG<br>CCCAAATCTTGTGACAAAACTCACACATGCCCACCGTGCCC<br>AGCACCTGAACTCCTGGGGGGACCGTCAGTCTTCCTCTTCCC<br>CCCAAAACCCAAGGACACCCTCATGATCTCCCGGACCCCTG<br>AGGTCACATGCGTGGTGGTGGACGTGAGCCACGAAGACCCT<br>GAGGTCAAGTTCAACTGGTACGTGGACGGCGTGGAGGTGCA<br>TAATGCCAAGACAAAGCCGTGCGAGGAGCAGTACGGCAGC<br>ACGTACCGTTGCGTCAGCGTCCTCACCGTCCTGCACCAGGA<br>CTGGCTGAATGGCAAGGAGTACAAGTGCAAGGTGTCCAACA<br>AAGCCCTCCCAGCCCCCATCGAGAAAACCATCTCCAAAGCC<br>AAAGGGCAGCCCCGAGAACCACAGGTGTACACCCTGCCCCC<br>ATCCCGGGAGGAGATGACCAAGAACCAGGTCAGCCTGACCT<br>GCCTGGTCAAAGGCTTCTATCCCAGCGACATCGCCGTGGAG<br>TGGGAGAGCAATGGGCAGCCGGAGAACAACTACAAGACCA<br>CGCCTCCCGTGCTGGACTCCGACGGCTCCTTCTTCCTCTATA<br>GCAAGCTCACCGTGGACAAGAGCAGGTGGCAGCAGGGGAA<br>CGTCTTCTCATGCTCCGTGATGCATGAGGCTCTGCACAACCA<br>CTACACGCAGAAGAGCCTCTCCCTGTCTCCGGGTAAA<br>(SEQ ID NO: 81) |
| | | AA | EIVMTQSPATLSVSPGERATLS<br>CRASQSVFSHLAWYQQKPGQA<br>PRLLIYEAATRATGIPARVSGSG<br>SGTEFTLTISSLQSEDFAVYYCQ<br>QYQNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 82) | QVQLVESGGGVVQPGRSLRLSCAASGFTFQNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 83) |
| 2G10.326 | [hu anti-<br><huGIPR><br>2G10.326<br>VK3 (1-236)<br>VL]::huKLC<br>-CL + [hu<br>anti-<br><huGIPR><br>2G10.301<br>VH3 (1-472)<br>VH]::huIgG1<br>zSEFL2-2<br>(mAb); LMR<br>ID: SS-<br>26203 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTCTGAGTCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCCAGAACTATGGCATGCACTGGGTCCGCCAGGCTCCA<br>GGCGAGGGGCTGGAGTGGGTGGCAGCTATATGGTTTGATGC<br>GTCTGACAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATCTTGCGATTTTTGGAGTGGTCCCCGACTACTG<br>GGGCCAGGGAACCCTGGTCACCGTGTCTAGTGCCTCCACCA<br>AGGGCCCATCGGTCTTCCCCCTGGCACCCTCCTCCAAGAGC<br>ACCTCTGGGGGCACAGCGGCCCTGGGCTGCCTGGTCAAGGA<br>CTACTTCCCCGAACCGGTGACGGTGTCGTGGAACTCAGGCG<br>CCCTGACCAGCGGCGTGCACACCTTCCCGGCTGTCCTACAG<br>TCCTCAGGACTCTACTCCCTCAGCAGCGTGGTGACCGTGCCC<br>TCCAGCAGCTTGGGCACCCAGACCTACATCTGCAACGTGAA<br>TCACAAGCCCAGCAACACCAAGGTGGACAAGAAAGTTGAG<br>CCCAAATCTTGTGACAAAACTCACACATGCCCACCGTGCCC<br>AGCACCTGAACTCCTGGGGGGACCGTCAGTCTTCCTCTTCCC<br>CCCAAAACCCAAGGACACCCTCATGATCTCCCGGACCCCTG<br>AGGTCACATGCGTGGTGGTGGACGTGAGCCACGAAGACCCT<br>GAGGTCAAGTTCAACTGGTACGTGGACGGCGTGGAGGTGCA<br>TAATGCCAAGACAAAGCCGTGCGAGGAGCAGTACGGCAGC<br>ACGTACCGTTGCGTCAGCGTCCTCACCGTCCTGCACCAGGA<br>CTGGCTGAATGGCAAGGAGTACAAGTGCAAGGTGTCCAACA<br>AAGCCCTCCCAGCCCCCATCGAGAAAACCATCTCCAAAGCC<br>AAAGGGCAGCCCCGAGAACCACAGGTGTACACCCTGCCCCC |

TABLE 5-continued

| Exemplary Light and Heavy Chain Nucleic Acid ("NA") and Amino Acid ("AA") Sequences | | | | |
|---|---|---|---|---|
| Ab | Description | Type | LC | HC |
| | | | CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 84) | ATCCCGGGAGGAGATGACCAAGAACCAGGTCAGCCTGACCT<br>GCCTGGTCAAAGGCTTCTATCCCAGCGACATCGCCGTGGAG<br>TGGGAGAGCAATGGGCAGCCGGAGAACAACTACAAGACCA<br>CGCCTCCCGTGCTGGACTCCGACGGCTCCTTCTTCCTCTATA<br>GCAAGCTCACCGTGGACAAGAGCAGGTGGCAGCAGGGGAA<br>CGTCTTCTCATGCTCCGTGATGCATGAGGCTCTGCACAACCA<br>CTACACGCAGAAGAGCCTCTCCCTGTCTCCGGGTAAA<br>(SEQ ID NO: 85) |
| | | AA | EIVMTQSPATLSVSPGERATLS<br>CRASQSVLSHLAWYQQKPGQA<br>PRLLIYEAATRATGIPARFSGSG<br>SGTEFTLTISSLQSEDFAVYYCQ<br>QYQQWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 86) | QVQLVESGGGVVQPGRSLRLSCAASGFTFQNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 87) |
| 2G10.308 | [hu anti-<br><huGIPR><br>2G10.308<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26185 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTTTCAGCCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 88) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 89) |
| | | AA | EIVMTQSPATLSVSPGERATLS<br>CRASQSVFSHLAWYQQKPGQA<br>PRLLIYEAATRATGIPARFSGSG<br>SGTEFTLTISSLQSEDFAVYYCQ<br>QYQQWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 90) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 91) |
| 2G10.608 | [hu anti-<br><huGIPR><br>2G10.608<br>VK3 (1-236)<br>VL]::huKLC | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTTTCAGCCACTTAGCCTG | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA |

TABLE 5-continued

Exemplary Light and Heavy Chain Nucleic Acid ("NA") and Amino Acid ("AA") Sequences

| Ab | Description | Type | LC | HC |
|---|---|---|---|---|
| | -CL + [Unknown anti-<huGIPR> 2G10.610 VH3 (1-472) VH]::huIgG1 zSEFL2-2 (mAb); LMR ID: SS-26233 | | GTACCAGCAGAAACCTGGCC<br>AGGCTCCCAGGCTCCTCATCT<br>ACGAAGCAGCCACCAGGGCC<br>ACTGGTATCCCAGCCAGGGTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 92) | CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 93) |
| | | AA | EIVMTQSPATLSVSPGERATLS<br>CRASQSVFSHLAWYQQKPGQA<br>PRLLIYEAATRATGIPARVSGSG<br>SGTEFTLTISSLQSEDFAVYYCQ<br>QYQQWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 94) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 95) |
| 2G10.336 | [hu anti-<huGIPR> 2G10.336 VK3 (1-236) VL]::huKLC -CL + [hu anti-<huGIPR> 2G10.325 VH3 (1-472) VH]::huIgG1 zSEFK2-2 (mAb); LMR ID: SS-26213 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTCAGAGCCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATATTGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT |

TABLE 5-continued

| Exemplary Light and Heavy Chain Nucleic Acid ("NA") and Amino Acid ("AA") Sequences | | | | |
|---|---|---|---|---|
| Ab | Description | Type | LC | HC |
| | | | CTGCGAAGTCACCCATCAGGG<br>CCTGAGCTCGCCCGTCACAAA<br>GAGCTTCAACAGGGGAGAGT<br>GT<br>(SEQ ID NO: 96) | GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 97) |
| | | AA | EIVMTQSPATLSVSPGERATLS<br>CRASQSVQSHLAWYQQKPGQ<br>APRLLIYEAATRATGIPARFSGS<br>GSGTEFTLTISSLQSEDFAVYYC<br>QQYQNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 98) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDIAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 99) |
| 2G10.344 | [hu anti-<br><huGIPR><br>2G10.344<br>VK3 (1-236)<br>VL]::huKLC<br>-CL + [hu<br>anti-<br><huGIPR><br>2G10.325<br>VH3 (1-472)<br>VH]::huIgG1<br>zSEFL2-2<br>(mAb); LMR<br>ID: SS-<br>26221 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTAGTAGCCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 100) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATATTGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 101) |
| | | AA | EIVMTQSPATLSVSPGERATLS<br>CRASQSVSSHLAWYQQKPGQA<br>PRLLIYEAATRATGIPARFSGSG<br>SGTEFTLTISSLQSEDFAVYYCQ<br>QYQQWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 102) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDIAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 103) |
| 2G10.310 | [hu anti-<br><huGIPR><br>2G10.310<br>VK3 (1-236)<br>VL]::huKLC<br>-CL + | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTTTCACGCACTTAGCCTG<br>GTACCAGCAGAAACCTGGCC | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA |

TABLE 5-continued

| Exemplary Light and Heavy Chain Nucleic Acid ("NA") and Amino Acid ("AA") Sequences | | | | |
|---|---|---|---|---|
| Ab | Description | Type | LC | HC |
| | [Unknown anti- <huGIPR> 2G10.610 VH3 (1-472) VH]::huIgG1 zSEFL2-2 (mAb); LMR ID: SS-26187 | | AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 104) | ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 105) |
| | | AA | EIVMTQSPATLSVSPGERATLS<br>CRASQSVFTHLAWYQQKPGQA<br>PRLLIYEAATRATGIPARFSGSG<br>SGTEFTLTISSLQSEDFAVYYCQ<br>QYNNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 106) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 107) |
| 2G10.610 | [Unknown anti- <huGIPR> 2G10.610 VK3 (1-236) VL]::huKLC -CL + [Unknown anti- <huGIPR> 2G10.610 VH3 (1-472) VH]::huIgG1 zSEFL2-2 (mAb); LMR ID: SS-26235 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTTTCACGCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGGTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT |

TABLE 5-continued

Exemplary Light and Heavy Chain Nucleic Acid ("NA") and Amino Acid ("AA") Sequences

| Ab | Description | Type | LC | HC |
|---|---|---|---|---|
| | | | CTGCGAAGTCACCCATCAGGG<br>CCTGAGCTCGCCCGTCACAAA<br>GAGCTTCAACAGGGGAGAGT<br>GT<br>(SEQ ID NO: 108) | GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 109) |
| | | AA | EIVMTQSPATLSVSPGERATLS<br>CRASQSVFTHLAWYQQKPGQA<br>PRLLIYEAATRATGIPARVSGSG<br>SGTEFTLTISSLQSEDFAVYYCQ<br>QYNNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 110) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 111) |
| 2G10.312 | [hu anti-<br><huGIPR><br>2G10.302<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26189 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTTTTGAACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 112) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 113) |
| | | AA | EIVMTQSPATLSVSPGERATLS<br>CRASQSVFEHLAWYQQKPGQA<br>PRLLIYEAATRATGIPARFSGSG<br>SGTEFTLTISSLQSEDFAVYYCQ<br>QYNNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 114) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 115) |
| 2G10.329 | [hu anti-<br><huGIPR><br>2G10.329<br>VK3 (1-236)<br>VL]::huKLC<br>-CL + | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTGAACAGCACTTAGCCTG<br>GTACCAGCAGAAACCTGGCC | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA |

TABLE 5-continued

Exemplary Light and Heavy Chain Nucleic Acid ("NA") and Amino Acid ("AA") Sequences

| Ab | Description | Type | LC | HC |
|---|---|---|---|---|
| | [Unknown anti-<huGIPR> 2G10.610 VH3 (1-472) VH]::huIgG1 zSEFL2-2 (mAb); LMR ID: SS-26206 | | AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 116) | ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 117) |
| | | AA | EIVMTQSPATLSVSPGERATLS<br>CRASQSVEQHLAWYQQKPGQ<br>APRLLIYEAATRATGIPARFSGS<br>GSGTEFTLTISSLQSEDFAVYYC<br>QQYNNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 118) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 119) |
| 2G10.327 | [hu anti-<huGIPR> 2G10.327 VK3 (1-236) VL]::huKLC -CL + [Unknown anti-<huGIPR> 2G10.610 VH3 (1-472) VH]::huIgG1 zSEFL2-2 (mAb); LMR ID: SS-26204 | NA | GAAATAGTGATGACGCAGTCT<br>CCGGCCACCCTGTCTGTGTCT<br>CCAGGGGAAAGAGCCACCCT<br>CTCCTGCAGGGCCAGTCAGAG<br>TGTTCATAGCCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG |

TABLE 5-continued

Exemplary Light and Heavy Chain Nucleic Acid ("NA") and Amino Acid ("AA") Sequences

| Ab | Description | Type | LC | HC |
|---|---|---|---|---|
| | | | CCTGAGCTCGCCCGTCACAAA<br>GAGCTTCAACAGGGGAGAGT<br>GT<br>(SEQ ID NO: 120) | ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 121) |
| | | AA | EIVMTQSPATLSVSPGERATLS<br>CRASQSVHSHLAWYQQKPGQ<br>APRLLIYEAATRATGIPARFSGS<br>GSGTEFTLTISSLQSEDFAVYYC<br>QQYNQWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 122) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 123) |
| 2G10.338 | [hu anti-<br><huGIPR><br>2G10.338<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26215 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTCATCATCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 124) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 125) |
| | | AA | EIVMTQSPATLSVSPGERATLS<br>CRASQSVHHHLAWYQQKPGQ<br>APRLLIYEAATRATGIPARFSGS<br>GSGTEFTLTISSLQSEDFAVYYC<br>QQYNQWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 126) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 127) |

TABLE 5-continued

| Exemplary Light and Heavy Chain Nucleic Acid ("NA") and Amino Acid ("AA") Sequences | | | | |
|---|---|---|---|---|
| **Ab** | **Description** | **Type** | **LC** | **HC** |
| 2G10.314 | [hu anti-<huGIPR> 2G10.314 VK3 (1-236) VL]::huKLC-CL + [Unknown anti-<huGIPR> 2G10.610 VH3 (1-472) VH]::huIgG1 zSEFL2-2 (mAb); LMR ID: SS-26191 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTCATAGCCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 128) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 129) |
| | | AA | EIVMTQSPATLSVSPGERATLS<br>CRASQSVHSHLAWYQQKPGQ<br>APRLLIYEAATRATGIPARFSGS<br>GSGTEFTLTISSLQSEDFAVYYC<br>QQYNNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 130) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 131) |
| 2G10.337 | [hu anti-<huGIPR> 2G10.337 VK3 (1-236) VL]::huKLC-CL + [Unknown anti-<huGIPR> 2G10.610 VH3 (1-472) VH]::huIgG1 zSEFL2-2 (mAb); LMR ID: SS-26214 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTGATGTCAACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC |

TABLE 5-continued

Exemplary Light and Heavy Chain Nucleic Acid ("NA") and Amino Acid ("AA") Sequences

| Ab | Description | Type | LC | HC |
| --- | --- | --- | --- | --- |
| | | | CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 132) | CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 133) |
| | | AA | EIVMTQSPATLSVSPGERATLS<br>CRASQSVDVNLAWYQQKPGQ<br>APRLLIYEAATRATGIPARFSGS<br>GSGTEFTLTISSLQSEDFAVYYC<br>QQYNQWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 134) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 135) |
| 2G10.341 | [hu anti-<br><huGIPR><br>2G10.341<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26218 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTGATGTCCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 136) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 137) |
| | | AA | EIVMTQSPATLSVSPGERATLS<br>CRASQSVDVHLAWYQQKPGQ<br>APRLLIYEAATRATGIPARFSGS<br>GSGTEFTLTISSLQSEDFAVYYC<br>QQYNQWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 138) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 139) |

TABLE 5-continued

| Exemplary Light and Heavy Chain Nucleic Acid ("NA") and Amino Acid ("AA") Sequences | | | | |
|---|---|---|---|---|
| Ab | Description | Type | LC | HC |
| 2G10.302 | [hu anti-<br><huGIPR><br>2G10.302<br>VK3 (1-236)<br>VL]::huKLC<br>-CL + [hu<br>anti-<br><huGIPR><br>2G10.302<br>VH3 (1-472)<br>VH]::huIgG1<br>zSEFL2-2<br>(mAb); LMR<br>ID: SS-<br>26179 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTTTTGAACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 140) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATATTGCGATTTTTGGAGTGTTTCCCGACTACTG<br>GGGCCAGGGAACCCTGGTCACCGTGTCTAGTGCCTCCACCA<br>AGGGCCCATCGGTCTTCCCCCTGGCACCCTCCTCCAAGAGC<br>ACCTCTGGGGGCACAGCGGCCCTGGGCTGCCTGGTCAAGGA<br>CTACTTCCCCGAACCGGTGACGGTGTCGTGGAACTCAGGCG<br>CCCTGACCAGCGGCGTGCACACCTTCCCGGCTGTCCTACAG<br>TCCTCAGGACTCTACTCCCTCAGCAGCGTGGTGACCGTGCCC<br>TCCAGCAGCTTGGGCACCCAGACCTACATCTGCAACGTGAA<br>TCACAAGCCCAGCAACACCAAGGTGGACAAGAAAGTTGAG<br>CCCAAATCTTGTGACAAAACTCACACATGCCCACCGTGCCC<br>AGCACCTGAACTCCTGGGGGGACCGTCAGTCTTCCTCTTCCC<br>CCCAAAACCCAAGGACACCCTCATGATCTCCCGGACCCCTG<br>AGGTCACATGCGTGGTGGTGGACGTGAGCCACGAAGACCCT<br>GAGGTCAAGTTCAACTGGTACGTGGACGGCGTGGAGGTGCA<br>TAATGCCAAGACAAAGCCGTGCGAGGAGCAGTACGGCAGC<br>ACGTACCGTTGCGTCAGCGTCCTCACCGTCCTGCACCAGGA<br>CTGGCTGAATGGCAAGGAGTACAAGTGCAAGGTGTCCAACA<br>AAGCCCTCCCAGCCCCCATCGAGAAAACCATCTCCAAAGCC<br>AAAGGGCAGCCCCGAGAACCACAGGTGTACACCCTGCCCCC<br>ATCCCGGGAGGAGATGACCAAGAACCAGGTCAGCCTGACCT<br>GCCTGGTCAAAGGCTTCTATCCCAGCGACATCGCCGTGGAG<br>TGGGAGAGCAATGGGCAGCCGGAGAACAACTACAAGACCA<br>CGCCTCCCGTGCTGGACTCCGACGGCTCCTTCTTCCTCTATA<br>GCAAGCTCACCGTGGACAAGAGCAGGTGGCAGCAGGGGAA<br>CGTCTTCTCATGCTCCGTGATGCATGAGGCTCTGCACAACCA<br>CTACACGCAGAAGAGCCTCTCCCTGTCTCCGGGTAAA<br>(SEQ ID NO: 141) |
| | | AA | EIVMTQSPATLSVSPGERATLS<br>CRASQSVFEHLAWYQQKPGQA<br>PRLLIYEAATRATGIPARFSGSG<br>SGTEFTLTISSLQSEDFAVYYCQ<br>QYNNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br><br>(SEQ ID NO: 142) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDIAIFGVFPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 143) |
| 2G10.602 | [hu anti-<br><huGIPR><br>2G10.602<br>VK3 (1-236)<br>VL]::huKLC<br>-CL + [hu<br>anti-<br><huGIPR><br>2G10.302<br>VH3 (1-472)<br>VH]::huIgG1<br>zSEFL2-2<br>(mAb); LMR<br>ID: SS-<br>26227 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTTTTGAACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGGTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATATTGCGATTTTTGGAGTGTTTCCCGACTACTG<br>GGGCCAGGGAACCCTGGTCACCGTGTCTAGTGCCTCCACCA<br>AGGGCCCATCGGTCTTCCCCCTGGCACCCTCCTCCAAGAGC<br>ACCTCTGGGGGCACAGCGGCCCTGGGCTGCCTGGTCAAGGA<br>CTACTTCCCCGAACCGGTGACGGTGTCGTGGAACTCAGGCG<br>CCCTGACCAGCGGCGTGCACACCTTCCCGGCTGTCCTACAG<br>TCCTCAGGACTCTACTCCCTCAGCAGCGTGGTGACCGTGCCC<br>TCCAGCAGCTTGGGCACCCAGACCTACATCTGCAACGTGAA<br>TCACAAGCCCAGCAACACCAAGGTGGACAAGAAAGTTGAG<br>CCCAAATCTTGTGACAAAACTCACACATGCCCACCGTGCCC<br>AGCACCTGAACTCCTGGGGGGACCGTCAGTCTTCCTCTTCCC<br>CCCAAAACCCAAGGACACCCTCATGATCTCCCGGACCCCTG<br>AGGTCACATGCGTGGTGGTGGACGTGAGCCACGAAGACCCT<br>GAGGTCAAGTTCAACTGGTACGTGGACGGCGTGGAGGTGCA<br>TAATGCCAAGACAAAGCCGTGCGAGGAGCAGTACGGCAGC<br>ACGTACCGTTGCGTCAGCGTCCTCACCGTCCTGCACCAGGA<br>CTGGCTGAATGGCAAGGAGTACAAGTGCAAGGTGTCCAACA<br>AAGCCCTCCCAGCCCCCATCGAGAAAACCATCTCCAAAGCC<br>AAAGGGCAGCCCCGAGAACCACAGGTGTACACCCTGCCCCC<br>ATCCCGGGAGGAGATGACCAAGAACCAGGTCAGCCTGACCT |

TABLE 5-continued

Exemplary Light and Heavy Chain Nucleic Acid ("NA") and Amino Acid ("AA") Sequences

| Ab | Description | Type | LC | HC |
|---|---|---|---|---|
| | | | GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 144) | GCCTGGTCAAAGGCTTCTATCCCAGCGACATCGCCGTGGAG<br>TGGGAGAGCAATGGGCAGCCGGAGAACAACTACAAGACCA<br>CGCCTCCCGTGCTGGACTCCGACGGCTCCTTCTTCCTCTATA<br>GCAAGCTCACCGTGGACAAGAGCAGGTGGCAGCAGGGGAA<br>CGTCTTCTCATGCTCCGTGATGCATGAGGCTCTGCACAACCA<br>CTACACGCAGAAGAGCCTCTCCCTGTCTCCGGGTAAA<br>(SEQ ID NO: 145) |
| | | AA | EIVMTQSPATLSVSPGERATLS<br>CRASQSVFEHLAWYQQKPGQA<br>PRLLIYEAATRATGIPARVSGSG<br>SGTEFTLTISSLQSEDFAVYYCQ<br>QYNNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 146) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDIAIFGVFPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 147) |
| 2G10.325 | [hu anti-<br><huGIPR><br>2G10.325<br>VK3 (1-236)<br>VL]::huKLC<br>-CL + [hu<br>anti-<br><huGIPR><br>2G10.325<br>VH3 (1-472)<br>VH]::huIgG1<br>zSEFL2-2<br>(mAb); LMR<br>ID: SS-<br>26202 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTTTCGAACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 148) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATATTGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 149) |
| | | AA | EIVMTQSPATLSVSPGERATLS<br>CRASQSVFEHLAWYQQKPGQA<br>PRLLIYEAATRATGIPARFSGSG<br>SGTEFTLTISSLQSEDFAVYYCQ<br>QYNQWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 150) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDIAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 151) |

TABLE 5-continued

Exemplary Light and Heavy Chain Nucleic Acid ("NA") and Amino Acid ("AA") Sequences

| Ab | Description | Type | LC | HC |
|---|---|---|---|---|
| 2G10.343 | [hu anti-<br><huGIPR><br>2G10.343<br>VK3 (1-236)<br>VL]::huKLC<br>-CL + [hu<br>anti-<br><huGIPR><br>2G10.325<br>VH3 (1-472)<br>VH]::huIgG1<br>zSEFL2-2<br>(mAb); LMR<br>ID: SS-<br>26220 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTCTGGAACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 152) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATATTGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 153) |
| | | AA | EIVMTQSPATLSVSPGERATLS<br>CRASQSVLEHLAWYQQKPGQA<br>PRLLIYEAATRATGIPARFSGSG<br>SGTEFTLTISSLQSEDFAVYYCQ<br>QYNNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 154) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDIAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 155) |
| 2G10.313 | [hu anti-<br><huGIPR><br>2G10.307<br>VK3 (1-236)<br>VL]::huKLC<br>-CL + [hu<br>anti-<br><huGIPR><br>2G10.302<br>VH3 (1-472)<br>VH]::huIgG1<br>zSEFL2-2<br>(mAb); LMR<br>ID: SS-<br>26190 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTGATAGACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATATTGCGATTTTTGGAGTGTTTCCCGACTACTG<br>GGGCCAGGGAACCCTGGTCACCGTGTCTAGTGCCTCCACCA<br>AGGGCCCATCGGTCTTCCCCCTGGCACCCTCCTCCAAGAGC<br>ACCTCTGGGGGCACAGCGGCCCTGGGCTGCCTGGTCAAGGA<br>CTACTTCCCCGAACCGGTGACGGTGTCGTGGAACTCAGGCG<br>CCCTGACCAGCGGCGTGCACACCTTCCCGGCTGTCCTACAG<br>TCCTCAGGACTCTACTCCCTCAGCAGCGTGGTGACCGTGCCC<br>TCCAGCAGCTTGGGCACCCAGACCTACATCTGCAACGTGAA<br>TCACAAGCCCAGCAACACCAAGGTGGACAAGAAAGTTGAG<br>CCCAAATCTTGTGACAAAACTCACACATGCCCACCGTGCCC<br>AGCACCTGAACTCCTGGGGGGACCGTCAGTCTTCCTCTTCCC<br>CCCAAAACCCAAGGACACCCTCATGATCTCCCGGACCCCTG<br>AGGTCACATGCGTGGTGGTGGACGTGAGCCACGAAGACCCT<br>GAGGTCAAGTTCAACTGGTACGTGGACGGCGTGGAGGTGCA<br>TAATGCCAAGACAAAGCCGTGCGAGGAGCAGTACGGCAGC<br>ACGTACCGTTGCGTCAGCGTCCTCACCGTCCTGCACCAGGA<br>CTGGCTGAATGGCAAGGAGTACAAGTGCAAGGTGTCCAACA<br>AAGCCCTCCCAGCCCCCATCGAGAAAACCATCTCCAAAGCC<br>AAAGGGCAGCCCCGAGAACCACAGGTGTACACCCTGCCCCC |

TABLE 5-continued

Exemplary Light and Heavy Chain Nucleic Acid ("NA") and Amino Acid ("AA") Sequences

| Ab | Description | Type | LC | HC |
|---|---|---|---|---|
| | | | CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 156) | ATCCCGGGAGGAGATGACCAAGAACCAGGTCAGCCTGACCT<br>GCCTGGTCAAAGGCTTCTATCCCAGCGACATCGCCGTGGAG<br>TGGGAGAGCAATGGGCAGCCGGAGAACAACTACAAGACCA<br>CGCCTCCCGTGCTGGACTCCGACGGCTCCTTCTTCCTCTATA<br>GCAAGCTCACCGTGGACAAGAGCAGGTGGCAGCAGGGGAA<br>CGTCTTCTCATGCTCCGTGATGCATGAGGCTCTGCACAACCA<br>CTACACGCAGAAGAGCCTCTCCCTGTCTCCGGGTAAA<br>(SEQ ID NO: 157) |
| | | AA | EIVMTQSPATLSVSPGERATLS<br>CRASQSVDRHLAWYQQKPGQ<br>APRLLIYEAATRATGIPARFSGS<br>GSGTEFTLTISSLQSEDFAVYYC<br>QQYNQWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 158) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDIAIFGVFPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 159) |
| 2G10.317 | [hu anti-<br><huGIPR><br>2G10.317<br>VK3 (1-236)<br>VL]::huKLC<br>-CL + [hu<br>anti-<br><huGIPR><br>2G10.302<br>VH3 (1-472)<br>VH]::huIgG1<br>zSEFL2-2<br>(mAb); LMR<br>ID: SS-<br>26194 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTAACCGGCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 160) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATATTGCGATTTTTGGAGTGTTTCCCGACTACTG<br>GGGCCAGGGAACCCTGGTCACCGTGTCTAGTGCCTCCACCA<br>AGGGCCCATCGGTCTTCCCCCTGGCACCCTCCTCCAAGAGC<br>ACCTCTGGGGGCACAGCGGCCCTGGGCTGCCTGGTCAAGGA<br>CTACTTCCCCGAACCGGTGACGGTGTCGTGGAACTCAGGCG<br>CCCTGACCAGCGGCGTGCACACCTTCCCGGCTGTCCTACAG<br>TCCTCAGGACTCTACTCCCTCAGCAGCGTGGTGACCGTGCCC<br>TCCAGCAGCTTGGGCACCCAGACCTACATCTGCAACGTGAA<br>TCACAAGCCCAGCAACACCAAGGTGGACAAGAAAGTTGAG<br>CCCAAATCTTGTGACAAAACTCACACATGCCCACCGTGCCC<br>AGCACCTGAACTCCTGGGGGGACCGTCAGTCTTCCTCTTCCC<br>CCCAAAACCCAAGGACACCCTCATGATCTCCCGGACCCCTG<br>AGGTCACATGCGTGGTGGTGGACGTGAGCCACGAAGACCCT<br>GAGGTCAAGTTCAACTGGTACGTGGACGGCGTGGAGGTGCA<br>TAATGCCAAGACAAAGCCGTGCGAGGAGCAGTACGGCAGC<br>ACGTACCGTTGCGTCAGCGTCCTCACCGTCCTGCACCAGGA<br>CTGGCTGAATGGCAAGGAGTACAAGTGCAAGGTGTCCAACA<br>AAGCCCTCCCAGCCCCCATCGAGAAAACCATCTCCAAAGCC<br>AAAGGGCAGCCCCGAGAACCACAGGTGTACACCCTGCCCCC<br>ATCCCGGGAGGAGATGACCAAGAACCAGGTCAGCCTGACCT<br>GCCTGGTCAAAGGCTTCTATCCCAGCGACATCGCCGTGGAG<br>TGGGAGAGCAATGGGCAGCCGGAGAACAACTACAAGACCA<br>CGCCTCCCGTGCTGGACTCCGACGGCTCCTTCTTCCTCTATA<br>GCAAGCTCACCGTGGACAAGAGCAGGTGGCAGCAGGGGAA<br>CGTCTTCTCATGCTCCGTGATGCATGAGGCTCTGCACAACCA<br>CTACACGCAGAAGAGCCTCTCCCTGTCTCCGGGTAAA<br>(SEQ ID NO: 161) |
| | | AA | EIVMTQSPATLSVSPGERATLS<br>CRASQSVNRHLAWYQQKPGQ<br>APRLLIYEAATRATGIPARFSGS<br>GSGTEFTLTISSLQSEDFAVYYC<br>QQYQQWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 162) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDIAIFGVFPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 163) |

TABLE 5-continued

Exemplary Light and Heavy Chain Nucleic Acid ("NA") and Amino Acid ("AA") Sequences

| Ab | Description | Type | LC | HC |
|---|---|---|---|---|
| 2G10.311 | [hu anti-<huGIPR> 2G10.311 VK3 (1-236) VL]::huKLC-CL + [hu anti-<huGIPR> 2G10.302 VH3 (1-472) VH]::huIgG1 zSEFL2-2 (mAb); LMR ID: SS-26188 | NA | GAAATAGTGATGACGCAGTCTCCAGCCACCCTGTCTGTGTCTCCAGGGGAAAGAGCCACCCTCTCCTGCAGGGCCAGTCAGAGTGTTAACGTACACTTAGCCTGGTACCAGCAGAAACCTGGCCAGGCTCCCAGGCTCCTCATCTACCAGGCAGCCACCAGGGCCACTGGTATCCCAGCCAGGTTCAGTGGCAGTGGGTCTGGGACAGAGTTCACTCTCACCATCAGCAGCCTGCAGTCTGAAGATTTTGCAGTTTATTACTGTCAGCAGTATAACCAGTGGCCTCTCACTTTCGGCGGAGGGACCAAGGTGGAGATCAAACGAACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGT (SEQ ID NO: 164) | CAGGTGCAGCTGGTGGAGTCTGGGGGAGGCGTGGTCCAGCCTGGGAGGTCCCTGAGACTCTCCTGTGCAGCATCTGGATTCACCTTCAGTAACTATGGCATGCACTGGGTCCGCCAGGCTCCAGGCGAGGGGCTGGAGTGGGTGGCAGCTATATGGTTTGATGCAAGTGATAAATACTATGCAGACGCCGTGAAGGGCCGATTCACCATCTCCAGAGACAACTCCAAGAACACGCTGTATCTGCAAATGAACAGCCTGAGAGCCGAGGACACGGCTGTGTATTACTGTGCGAGAGATATTGCGATTTTTGGAGTGTTTCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA (SEQ ID NO: 165) |
| | | AA | EIVMTQSPATLSVSPGERATLSCRASQSVNVHLAWYQQKPGQAPRLLIYQAATRATGIPARFSGSGSGTEFTLTISSLQSEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 166) | QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDIAIFGVFPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 167) |
| 2G10.306 | [hu anti-<huGIPR> 2G10.306 VK3 (1-236) VL]::huKLC-CL + [hu anti-<huGIPR> 2G10.306 VH3 (1-472) VH]::huIgG1 zSEFL2-2 (mAb); LMR ID: SS-26183 | NA | GAAATAGTGATGACGCAGTCTCCAGCCACCCTGTCTGTGTCTCCAGGGGAAAGAGCCACCCTCTCCTGCAGGGCCAGTCAGAGTGTTCTGACGCACTTAGCCTGGTACCAGCAGAAACCTGGCCAGGCTCCCAGGCTCCTCATCTACGAAGCAGCCACCAGGGCCACTGGTATCCCAGCCAGGTTCAGTGGCAGTGGGTCTGGGACAGAGTTCACTCTCACCATCAGCAGCCTGCAGTCTGAAGATTTTGCAGTTTATTACTGTCAGCAGTATCAGAACTGGCCTCTCACTTTCGGCGGAGGGACCAAGGTGGAGATCAAACGAACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTAC | CAGGTGCAGCTGGTGGAGTCTGGGGGAGGCGTGGTCCAGCCTGGGAGGTCCCTGAGACTCTCCTGTGCAGCATCTGGATTCACCTTCAGTAACTATGGCATGCACTGGGTCCGCCAGGCTCCAGGCGAGGGGCTGGAGTGGGTGGCAGCTATATGGTTTGATGCAAGTGATAAATACTATGCAGACGCCGTGAAGGGCCGATTCACCATCTCCAGAGACAACTCCAAGAACACGCTGTATCTGCAAATGAACAGCCTGAGAGCCGAGGACACGGCTGTGTATTACTGTGCGAGAGATATTGCGATTTTTGGAGTGATCCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTG |

TABLE 5-continued

| Exemplary Light and Heavy Chain Nucleic Acid ("NA") and Amino Acid ("AA") Sequences | | | | |
|---|---|---|---|---|
| Ab | Description | Type | LC | HC |
| | | | GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 168) | ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 169) |
| | | AA | EIVMTQSPATLSVSPGERATLS<br>CRASQSVLTHLAWYQQKPGQA<br>PRLLIYEAATRATGIPARFSGSG<br>SGTEFTLTISSLQSEDFAVYYCQ<br>QYQNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 170) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDIAIFGVIPDYWGQGTLVTVSSASTKG<br>PSVFPLAPSSKSTSGGTAALGCLVKDYFPEPVTVSWNSGALTS<br>GVHTFPAVLQSSGLYSLSSVVTVPSSSLGTQTYICNVNHKPSNT<br>KVDKKVEPKSCDKTHTCPPCPAPELLGGPSVFLFPPKPKDTLMI<br>SRTPEVTCVVVDVSHEDPEVKFNWYVDGVEVHNAKTKPCEEQ<br>YGSTYRCVSVLTVLHQDWLNGKEYKCKVSNKALPAPIEKTISK<br>AKGQPREPQVYTLPPSREEMTKNQVSLTCLVKGFYPSDIAVEW<br>ESNGQPENNYKTTPPVLDSDGSFFLYSKLTVDKSRWQQGNVFS<br>CSVMHEALHNHYTQKSLSLSPGK<br>(SEQ ID NO: 171) |
| 2G10.606 | [hu anti-<br><huGIPR><br>2G10.606<br>VK3 (1-236)<br>VL]::huKLC<br>-CL + [hu<br>anti-<br><huGIPR><br>2G10.306<br>VH3 (1-472)<br>VH]::huIgG1<br>zSEFL2-2<br>(mAb); LMR<br>ID: SS-<br>26231 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTCTGACGCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGGTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 172) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATATTGCGATTTTTGGAGTGATCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 173) |
| | | AA | EIVMTQSPATLSVSPGERATLS<br>CRASQSVLTHLAWYQQKPGQA<br>PRLLIYEAATRATGIPARVSGSG<br>SGTEFTLTISSLQSEDFAVYYCQ<br>QYQNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 174) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDIAIFGVIPDYWGQGTLVTVSSASTKG<br>PSVFPLAPSSKSTSGGTAALGCLVKDYFPEPVTVSWNSGALTS<br>GVHTFPAVLQSSGLYSLSSVVTVPSSSLGTQTYICNVNHKPSNT<br>KVDKKVEPKSCDKTHTCPPCPAPELLGGPSVFLFPPKPKDTLMI<br>SRTPEVTCVVVDVSHEDPEVKFNWYVDGVEVHNAKTKPCEEQ<br>YGSTYRCVSVLTVLHQDWLNGKEYKCKVSNKALPAPIEKTISK<br>AKGQPREPQVYTLPPSREEMTKNQVSLTCLVKGFYPSDIAVEW<br>ESNGQPENNYKTTPPVLDSDGSFFLYSKLTVDKSRWQQGNVFS<br>CSVMHEALHNHYTQKSLSLSPGK<br>(SEQ ID NO: 175) |

TABLE 5-continued

| Exemplary Light and Heavy Chain Nucleic Acid ("NA") and Amino Acid ("AA") Sequences | | | | |
|---|---|---|---|---|
| Ab | Description | Type | LC | HC |
| 2G10.347 | anti-<huGIPR> 21-143_2G10_LC1.005 (1-237)(S73(85)A) VL+[Unknown anti-<huGIPR> 2G10.610 VH3 (1-472) VH]::huIgG1 zSEFL2-2 (mAb); LMR ID: SS-26224 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTAGCAGCAACTTAGCCTG<br>GTACCAGCAGAAACCTGGCC<br>AGGCTCCCAGGCTCCTCATCT<br>ATGGTGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAATAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 176) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 177) |
| | | AA | EIVMTQSPATLSVSPGERATLS<br>CRASQSVSSNLAWYQQKPGQA<br>PRLLIYGAATRATGIPARFSGSG<br>SGTEFTLTISSLQSEDFAVYYCQ<br>QYNNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 178) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 179) |
| 2G10.348 | anti-<huGIPR> 21-143_2G10_LC1.005 (1-237)(S73(85)A) VL+ [hu anti-<huGIPR> 2G10.348 VH3 (1-472) VH]::huIgG1 zSEFL2-2 (mAb); LMR ID: SS-26225 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTAGCAGCAACTTAGCCTG<br>GTACCAGCAGAAACCTGGCC<br>AGGCTCCCAGGCTCCTCATCT<br>ATGGTGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAATAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATCAGGCGATTTTTGGAGTGGTCCCCGATTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA |

TABLE 5-continued

Exemplary Light and Heavy Chain Nucleic Acid ("NA") and Amino Acid ("AA") Sequences

| Ab | Description | Type | LC | HC |
|---|---|---|---|---|
| | | | GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 180) | ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 181) |
| | | AA | EIVMTQSPATLSVSPGERATLS<br>CRASQSVSSNLAWYQQKPGQA<br>PRLLIYGAATRATGIPARFSGSG<br>SGTEFTLTISSLQSEDFAVYYCQ<br>QYNNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 182) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDQAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 183) |
| 2G10.346 | anti-<br><huGIPR><br>21-<br>143_2G10_L<br>C1.005 (1-<br>237)(S73<br>(85)<br>A) VL + [hu<br>anti-<br><huGIPR><br>2G10.325<br>VH3 (1-472)<br>VH]::huIgG1<br>zSEFL2-2<br>(mAb), LMR<br>ID: SS-<br>26223 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTAGCAGCAACTTAGCCTG<br>GTACCAGCAGAAACCTGGCC<br>AGGCTCCCAGGCTCCTCATCT<br>ATGGTGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAATAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 184) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATATTGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 185) |
| | | AA | EIVMTQSPATLSVSPGERATLS<br>CRASQSVSSNLAWYQQKPGQA<br>PRLLIYGAATRATGIPARFSGSG<br>SGTEFTLTISSLQSEDFAVYYCQ<br>QYNNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 186) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDIAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 187) |

TABLE 5-continued

Exemplary Light and Heavy Chain Nucleic Acid ("NA") and Amino Acid ("AA") Sequences

| Ab | Description | Type | LC | HC |
|---|---|---|---|---|
| 2G10.647 | [hu anti-<huGIPR> 2G10.647 VK3 (1-236) VL]::huKLC-CL + [Unknown anti-<huGIPR> 2G10.610 VH3 (1-472) VH]::huIgG1 zSEFL2-2 (mAb); LMR ID: SS-26236 | NA | GAAATAGTGATGACGCAGTCTCCAGCCACCCTGTCTGTGTCTCCAGGGGAAAGAGCCACCCTCTCCTGCAGGGCCAGTCAGAGTGTTAGCAGCAACTTAGCCTGGTACCAGCAGAAACCTGGCCAGGCTCCCAGGCTCCTCATCTATGGTGCAGCCACCAGGGCCACTGGTATCCCAGCCAGGGTCAGTGGCAGTGGGTCTGGGACAGAGTTCACTCTCACCATCAGCAGCCTGCAGTCTGAAGATTTTGCAGTTTATTACTGTCAGCAGTATAATAACTGGCCTCTCACTTTCGGCGGAGGGACCAAGGTGGAGATCAAACGAACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGT (SEQ ID NO: 188) | CAGGTGCAGCTGGTGGAGTCTGGGGGAGGCGTGGTCCAGCCTGGGAGGTCCCTGAGACTCTCCTGTGCAGCATCTGGATTCACCTTCAGTAACTATGGCATGCACTGGGTCCGCCAGGCTCCAGGCGAGGGGCTGGAGTGGGTGGCAGCTATATGGTTTGATGCAAGTGATAAATACTATGCAGACGCCGTGAAGGGCCGATTCACCATCTCCAGAGACAACTCCAAGAACACGCTGTATCTGCAAATGAACAGCCTGAGAGCCGAGGACACGGCTGTGTATTACTGTGCGAGAGATTTGGCGATTTTTGGAGTGGTCCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA (SEQ ID NO: 189) |
| | | AA | EIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 190) | QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 191) |
| 2G10.649 | [hu anti-<huGIPR> 2G10.649 VK3 (1-236) VL]::huKLC-CL + [hu anti-<huGIPR> 2G10.348 VH3 (1-472) VH]::huIgG1 zSEFL2-2 (mAb); LMR ID: SS-26237 | NA | GAAATAGTGATGACGCAGTCTCCAGCCACCCTGTCTGTGTCTCCAGGGGAAAGAGCCACCCTCTCCTGCAGGGCCAGTCAGAGTGTTAGCAGCAACTTAGCCTGGTACCAGCAGAAACCTGGCCAGGCTCCCAGGCTCCTCATCTATGAAGCAGCCACCAGGGCCACTGGTATCCCAGCCAGGGTCAGTGGCAGTGGGTCTGGGACAGAGTTCACTCTCACCATCAGCAGCCTGCAGTCTGAAGATTTTGCAGTTTATTACTGTCAGCAGTATAATAACTGGCCTCTCACTTTCGGCGGAGGGACCAAGGTGGAGATCAAACGAACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGA | CAGGTGCAGCTGGTGGAGTCTGGGGGAGGCGTGGTCCAGCCTGGGAGGTCCCTGAGACTCTCCTGTGCAGCATCTGGATTCACCTTCAGTAACTATGGCATGCACTGGGTCCGCCAGGCTCCAGGCGAGGGGCTGGAGTGGGTGGCAGCTATATGGTTTGATGCAAGTGATAAATACTATGCAGACGCCGTGAAGGGCCGATTCACCATCTCCAGAGACAACTCCAAGAACACGCTGTATCTGCAAATGAACAGCCTGAGAGCCGAGGACACGGCTGTGTATTACTGTGCGAGAGATCAGGCGATTTTTGGAGTGGTCCCCGATTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCC |

TABLE 5-continued

Exemplary Light and Heavy Chain Nucleic Acid ("NA") and Amino Acid ("AA") Sequences

| Ab | Description | Type | LC | HC |
|---|---|---|---|---|
| | | | CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 192) | CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 193) |
| | | AA | EIVMTQSPATLSVSPGERATLS<br>CRASQSVSSNLAWYQQKPGQA<br>PRLLIYEAATRATGIPARVSGSG<br>SGTEFTLTISSLQSEDFAVYYCQ<br>QYNNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 194) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDQAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 195) |
| 2G10.305 | [hu anti-<br><huGIPR><br>2G10.305<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26182 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTGATGTTAACTTAGCCTG<br>GTACCAGCAGAAACCTGGCC<br>AGGCTCCCAGGCTCCTCATCT<br>ACAACGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 196) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 197) |
| | | AA | EIVMTQSPATLSVSPGERATLS<br>CRASQSVDVNLAWYQQKPGQ<br>APRLLIYNAATRATGIPARFSGS<br>GSGTEFTLTISSLQSEDFAVYYC<br>QQYQNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 198) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 199) |
| 2G10.605 | [hu anti-<br><huGIPR><br>2G10.605<br>VK3 (1-236) | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC |

TABLE 5-continued

Exemplary Light and Heavy Chain Nucleic Acid ("NA") and Amino Acid ("AA") Sequences

| Ab | Description | Type | LC | HC |
|---|---|---|---|---|
| | VL]::huKLC -CL + [Unknown anti- <huGIPR> 2G10.610 VH3 (1-472) VH]::huIgG1 zSEFL2-2 (mAb); LMR ID: SS-26230 | | TGTTGATGTTAACTTAGCCTG<br>GTACCAGCAGAAACCTGGCC<br>AGGCTCCCAGGCTCCTCATCT<br>ACAACGCAGCCACCAGGGCC<br>ACTGGTATCCCAGCCAGGGTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAA<br>GAGCTTCAACAGGGGAGAGT<br>GT<br>(SEQ ID NO: 200) | AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 201) |
| | | AA | EIVMTQSPATLSVSPGERATLS<br>CRASQSVDVNLAWYQQKPGQ<br>APRLLIYNAATRATGIPARVSG<br>SGSGTEFTLTISSLQSEDFAVYY<br>CQQYQNWPLTFGGGTKVEIKR<br>TVAAPSVFIFPPSDEQLKSGTAS<br>VVCLLNNFYPREAKVQWKVD<br>NALQSGNSQESVTEQDSKDST<br>YSLSSTLTLSKADYEKHKVYA<br>CEVTHQGLSSPVTKSFNRGEC<br>(SEQ ID NO: 202) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 203) |
| 2G10.340 | [hu anti- <huGIPR> 2G10.340 VK3 (1-236) VL]::huKLC -CL + [hu anti- <huGIPR> 2G10.325 VH3 (1-472) VH]::huIgG1 zSEFL2-2 (mAb); LMR ID: SS-26217 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTCATACGAACTTAGCCTG<br>GTACCAGCAGAAACCTGGCC<br>AGGCTCCCAGGCTCCTCATCT<br>ACAACGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATATTGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG |

TABLE 5-continued

| Exemplary Light and Heavy Chain Nucleic Acid ("NA") and Amino Acid ("AA") Sequences | | | | |
|---|---|---|---|---|
| Ab | Description | Type | LC | HC |
| | | | GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 204) | ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 205) |
| | | AA | EIVMTQSPATLSVSPGERATLS<br>CRASQSVHTNLAWYQQKPGQ<br>APRLLIYNAATRATGIPARFSGS<br>GSGTEFTLTISSLQSEDFAVYYC<br>QQYQNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 206) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDIAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 207) |
| 2G10.334 | [hu anti-<br><huGIPR><br>2G10.334<br>VK3 (1-236)<br>VL]::huKLC<br>-CL +<br>[Unknown<br>anti-<br><huGIPR><br>2G10.610<br>VH3 (1-472)<br>VH]::huIgG1<br>zSEFL2-2<br>(mAb); LMR<br>ID: SS-<br>26211 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTAACCTGAACTTAGCCTG<br>GTACCAGCAGAAACCTGGCC<br>AGGCTCCCAGGCTCCTCATCT<br>ACCAGGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 208) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>AAGTGATAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATTTGGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 209) |
| | | AA | EIVMTQSPATLSVSPGERATLS<br>CRASQSVNLNLAWYQQKPGQ<br>APRLLIYQAATRATGIPARFSGS<br>GSGTEFTLTISSLQSEDFAVYYC<br>QQYNQWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 210) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 211) |

TABLE 5-continued

Exemplary Light and Heavy Chain Nucleic Acid ("NA") and Amino Acid ("AA") Sequences

| Ab | Description | Type | LC | HC |
|---|---|---|---|---|
| 2G10.339 | [hu anti-<huGIPR> 2G10.339 VK3 (1-236) VL]::huKLC -CL + [hu anti-<huGIPR> 2G10.325 VH3 (1-472) VH]::huIgG1 z-SEFL2-2 (mAb); LMR ID: SS-26216 | NA | GAAATAGTGATGACGCAGTCTCCAGCCACCCTGTCTGTGTCTCCAGGGGAAAGAGCCACCCTCTCCTGCAGGGCCAGTCAGAGTGTTTTCCAGAACTTAGCCTGGTACCAGCAGAAACCTGGCCAGGCTCCCAGGCTCCTCATCTACCAGGCAGCCACCAGGGCCACTGGTATCCCAGCCAGGTTCAGTGGCAGTGGGTCTGGGACAGAGTTCACTCTCACCATCAGCAGCCTGCAGTCTGAAGATTTTGCAGTTTATTACTGTCAGCAGTATAACCAGTGGCCTCTCACTTTCGGCGGAGGGACCAAGGTGGAGATCAAACGAACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGT (SEQ ID NO: 212) | CAGGTGCAGCTGGTGGAGTCTGGGGGAGGCGTGGTCCAGCCTGGGAGGTCCCTGAGACTCTCCTGTGCAGCATCTGGATTCACCTTCAGTAACTATGGCATGCACTGGGTCCGCCAGGCTCCAGGCGAGGGGCTGGAGTGGGTGGCAGCTATATGGTTTGATGCAAGTGATAAATACTATGCAGACGCCGTGAAGGGCCGATTCACCATCTCCAGAGACAACTCCAAGAACACGCTGTATCTGCAAATGAACAGCCTGAGAGCCGAGGACACGGCTGTGTATTACTGTGCGAGAGATATTGCGATTTTTGGAGTGGTCCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA (SEQ ID NO: 213) |
| | | AA | EIVMTQSPATLSVSPGERATLSCRASQSVFQNLAWYQQKPGQAPRLLIYQAATRATGIPARFSGSGSGTEFTLTISSLQSEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 214) | QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDIAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 215) |
| 2G10.307 | [hu anti-<huGIPR> 2G10.307 VK3 (1-236) VL]::huKLC -CL + [hu anti-<huGIPR> 2G10.307 VH3 (1-472) VH]::huIgG1 zSEFL2-2 (mAb); LMR ID: SS-26184 | NA | GAAATAGTGATGACGCAGTCTCCAGCCACCCTGTCTGTGTCTCCAGGGGAAAGAGCCACCCTCTCCTGCAGGGCCAGTCAGAGTGTTGATAGACACTTAGCCTGGTACCAGCAGAAACCTGGCCAGGCTCCCAGGCTCCTCATCTACGAAGCAGCCACCAGGGCCACTGGTATCCCAGCCAGGTTCAGTGGCAGTGGGTCTGGGACAGAGTTCACTCTCACCATCAGCAGCCTGCAGTCTGAAGATTTTGCAGTTTATTACTGTCAGCAGTATAACCAGTGGCCTCTCACTTTCGGCGGAGGGACCAAGGTGGAGATCAAACGAACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGA | CAGGTGCAGCTGGTGGAGTCTGGGGGAGGCGTGGTCCAGCCTGGGAGGTCCCTGAGACTCTCCTGTGCAGCATCTGGATTCACCTTCCAGAACTATGGCATGCACTGGGTCCGCCAGGCTCCAGGCGAGGGGCTGGAGTGGGTGGCAGCTATATGGTTTGATGCGTACGGTAAATACTATGCAGACGCCGTGAAGGGCCGATTCACCATCTCCAGAGACAACTCCAAGAACACGCTGTATCTGCAAATGAACAGCCTGAGAGCCGAGGACACGGCTGTGTATTACTGTGCGAGAGATATCAGACGATTTTTGGAGTGGTCCCCGACTACTGGGGCCAGGGAACCCTGGTCACCGTGTCTAGTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGCGAGGAGCAGTACGGCAGCACGTACCGTTGCGTCAGCGTCCTCACCGTCCTGCACCAGGACTGGCTGAATGGCAAGGAGTACAAGTGCAAGGTGTCCAACAAAGCCCTCCCAGCCCCCATCGAGAAAACCATCTCCAAAGCCAAAGGGCAGCCCCGAGAACCACAGGTGTACACCCTGCC |

TABLE 5-continued

| Ab | Description | Type | LC | HC |
|---|---|---|---|---|
| Exemplary Light and Heavy Chain Nucleic Acid ("NA") and Amino Acid ("AA") Sequences | | | | |
| | | | CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 216) | CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 217) |
| | | AA | EIVMTQSPATLSVSPGERATLS<br>CRASQSVDRHLAWYQQKPGQ<br>APRLLIYEAATRATGIPARFSGS<br>GSGTEFTLTISSLQSEDFAVYYC<br>QQYNQWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 218) | QVQLVESGGGVVQPGRSLRLSCAASGFTFQNYGMHWVRQAP<br>GEGLEWVAAIWFDAYGKYYADAVKGRFTISRDNSKNTLYLQ<br>MNSLRAEDTAVYYCARDQTIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 219) |
| 2G10.607 | [hu anti-<br><huGIPR><br>2G10.607<br>VK3 (1-236)<br>VL]::huKLC<br>-CL + [hu<br>anti-<br><huGIPR><br>2G10.307<br>VH3 (1-472)<br>VH]::huIgG1<br>zSEFL2-2<br>(mAb); LMR<br>ID: SS-<br>26232 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTGATAGACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGGTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 220) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCCAGAACTATGGCATGCACTGGGTCCGCCAGGCTCCA<br>GGCGAGGGGCTGGAGTGGGTGGCAGCTATATGGTTTGATGC<br>GTACGGTAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATCAGACGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 221) |
| | | AA | EIVMTQSPATLSVSPGERATLS<br>CRASQSVDRHLAWYQQKPGQ<br>APRLLIYEAATRATGIPARVSGS<br>GSGTEFTLTISSLQSEDFAVYYC<br>QQYNQWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 222) | QVQLVESGGGVVQPGRSLRLSCAASGFTFQNYGMHWVRQAP<br>GEGLEWVAAIWFDAYGKYYADAVKGRFTISRDNSKNTLYLQ<br>MNSLRAEDTAVYYCARDQTIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 223) |

TABLE 5-continued

Exemplary Light and Heavy Chain Nucleic Acid (“NA”) and Amino Acid (“AA”) Sequences

| Ab | Description | Type | LC | HC |
|---|---|---|---|---|
| 2G10.321 | [hu anti-<br><huGIPR><br>2G10.321<br>VK3 (1-236)<br>VL]::huKLC<br>-CL + [hu<br>anti-<br><huGIPR><br>2G10.321<br>VH3 (1-472)<br>VH]::huIgG1<br>zSEFL2-2<br>(mAb); LMR<br>ID: SS-<br>26198 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTAACCGGCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 224) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCCAGAACTATGGCATGCACTGGGTCCGCCAGGCTCCA<br>GGCGAGGGGCTGGAGTGGGTGGCAGCTATATGGTTTGATGC<br>GTACGGTAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATAAGACGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 225) |
| | | AA | EIVMTQSPATLSVSPGERATLS<br>CRASQSVNRHLAWYQQKPGQ<br>APRLLIYEAATRATGIPARFSGS<br>GSGTEFTLTISSLQSEDFAVYYC<br>QQYNQWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 226) | QVQLVESGGGVVQPGRSLRLSCAASGFTFQNYGMHWVRQAP<br>GEGLEWVAAIWFDAYGKYYADAVKGRFTISRDNSKNTLYLQ<br>MNSLRAEDTAVYYCARDKTIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 227) |
| 2G10.342 | [hu anti-<br><hu GIPR><br>2G10.342<br>VK3 (1-236)<br>VL]::huKLC<br>-CL + [hu<br>anti-<br><huGIPR><br>2G10.321<br>VH3 (1-472)<br>VH]::huIgG1<br>zSEFL2-2<br>(mAb); LMR<br>ID: SS-<br>26219 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTGAAAGACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCCAGAACTATGGCATGCACTGGGTCCGCCAGGCTCCA<br>GGCGAGGGGCTGGAGTGGGTGGCAGCTATATGGTTTGATGC<br>GTACGGTAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATAAGACGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC |

TABLE 5-continued

Exemplary Light and Heavy Chain Nucleic Acid ("NA") and Amino Acid ("AA") Sequences

| Ab | Description | Type | LC | HC |
|---|---|---|---|---|
| | | | CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 228) | CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 229) |
| | | AA | EIVMTQSPATLSVSPGERATLS<br>CRASQSVERHLAWYQQKPGQ<br>APRLLIYEAATRATGIPARFSGS<br>GSGTEFTLTISSLQSEDFAVYYC<br>QQYQQWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 230) | QVQLVESGGGVVQPGRSLRLSCAASGFTFQNYGMHWVRQAP<br>GEGLEWVAAIWFDAYGKYYADAVKGRFTISRDNSKNTLYLQ<br>MNSLRAEDTAVYYCARDKTIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 231) |
| 2G10.319 | [hu anti-<br><huGIPR><br>2G10.316<br>VK3 (1-236)<br>VL]::huKLC<br>-CL + [hu<br>anti-<br><huGIPR><br>2G10.319<br>VH3 (1-472)<br>VH]::huIgG1<br>zSEFL2-2<br>(mAb); LMR<br>ID: SS-<br>26196 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTTTCAGACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 232) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCAGTAACTATGGCATGCACTGGGTCCGCCAGGCTCCA<br>GGCGAGGGGCTGGAGTGGGTGGCAGCTATATGGTTTGATGC<br>GTACGGTAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATAAGACGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 233) |
| | | AA | EIVMTQSPATLSVSPGERATLS<br>CRASQSVFRHLAWYQQKPGQA<br>PRLLIYEAATRATGIPARFSGSG<br>SGTEFTLTISSLQSEDFAVYYCQ<br>QYQNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 234) | QVQLVESGGGVVQPGRSLRLSCAASGFTFSNYGMHWVRQAP<br>GEGLEWVAAIWFDAYGKYYADAVKGRFTISRDNSKNTLYLQ<br>MNSLRAEDTAVYYCARDKTIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 235) |

TABLE 5-continued

| Exemplary Light and Heavy Chain Nucleic Acid ("NA") and Amino Acid ("AA") Sequences | | | | |
|---|---|---|---|---|
| Ab | Description | Type | LC | HC |
| 2G10.332 | [hu anti-<br><huGIPR><br>2G10.318<br>VK3 (1-236)<br>VL]::huKLC<br>-CL + [hu<br>anti-<br><huGIPR><br>2G10.332<br>VH3 (1-472)<br>VH]::huIgG1<br>zSEFL2-2<br>(mAb); LMR<br>ID: SS-<br>26209 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTCTGAGTCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 236) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCCAGAACTATGGCATGCACTGGGTCCGCCAGGCTCCA<br>GGCGAGGGGCTGGAGTGGGTGGCAGCTATATGGTTTGATGC<br>GTACGACAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATAAGTCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 237) |
| | | AA | EIVMTQSPATLSVSPGERATLS<br>CRASQSVLSHLAWYQQKPGQA<br>PRLLIYEAATRATGIPARFSGSG<br>SGTEFTLTISSLQSEDFAVYYCQ<br>QYNNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 238) | QVQLVESGGGVVQPGRSLRLSCAASGFTFQNYGMHWVRQAP<br>GEGLEWVAAIWFDAYDKYYADAVKGRFTISRDNSKNTLYLQ<br>MNSLRAEDTAVYYCARDKSIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 239) |
| 2G10.345 | [hu anti-<br><huGIPR><br>2G10.345<br>VK3 (1-236)<br>VL]::huKLC<br>-CL + [hu<br>anti-<br><huGIPR><br>2G10.332<br>VH3 (1-472)<br>VH]::huIgG1<br>zSEFL2-2<br>(mAb); LMR<br>ID: SS-<br>26222 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTAACAGACACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCCAGAACTATGGCATGCACTGGGTCCGCCAGGCTCCA<br>GGCGAGGGGCTGGAGTGGGTGGCAGCTATATGGTTTGATGC<br>GTACGACAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATAAGTCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC |

TABLE 5-continued

| Exemplary Light and Heavy Chain Nucleic Acid ("NA") and Amino Acid ("AA") Sequences | | | | |
|---|---|---|---|---|
| Ab | Description | Type | LC | HC |
| | | | CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 240) | CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 241) |
| | | AA | EIVMTQSPATLSVSPGERATLS<br>CRASQSVNRHLAWYQQKPGQ<br>APRLLIYEAATRATGIPARFSGS<br>GSGTEFTLTISSLQSEDFAVYYC<br>QQYNNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 242) | QVQLVESGGGVVQPGRSLRLSCAASGFTFQNYGMHWVRQAP<br>GEGLEWVAAIWFDAYDKYYADAVKGRFTISRDNSKNTLYLQ<br>MNSLRAEDTAVYYCARDKSIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 243) |
| 2G10.335 | [hu anti-<br><huGIPR><br>2G10.335<br>VK3 (1-236)<br>VL]::huKLC<br>-CL + [hu<br>anti-<br><huGIPR><br>2G10.335<br>VH3 (1-472)<br>VH]::huIgG1<br>zSEFL2-2<br>(mAb); LMR<br>ID: SS-<br>26212 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTACCAGCCACTTAGCCTG<br>GTACCAGCAGAAACCTGGCC<br>AGGCTCCCAGGCTCCTCATCT<br>ACGAAGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATAACCAGTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 244) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCCAGAACTATGGCATGCACTGGGTCCGCCAGGCTCCA<br>GGCGAGGGGCTGGAGTGGGTGGCAGCTATATGGTTTGATGC<br>GTACGACAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATCTCGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 245) |
| | | AA | EIVMTQSPATLSVSPGERATLS<br>CRASQSVTSHLAWYQQKPGQA<br>PRLLIYEAATRATGIPARFSGSG<br>SGTEFTLTISSLQSEDFAVYYCQ<br>QYNQWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 246) | QVQLVESGGGVVQPGRSLRLSCAASGFTFQNYGMHWVRQAP<br>GEGLEWVAAIWFDAYDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 247) |

TABLE 5-continued

Exemplary Light and Heavy Chain Nucleic Acid ("NA") and Amino Acid ("AA") Sequences

| Ab | Description | Type | LC | HC |
|---|---|---|---|---|
| 2G10.330 | [hu anti-<br><huGIPR><br>2G10.330<br>VK3 (1-236)<br>VL]::huKLC<br>-CL + [hu<br>anti-<br><huGIPR><br>2G10.330<br>VH3 (1-472)<br>VH]::huIgG1<br>zSEFL2-2<br>(mAb); LMR<br>ID: SS-<br>26207 | NA | GAAATAGTGATGACGCAGTCT<br>CCAGCCACCCTGTCTGTGTCT<br>CCAGGGGAAAGAGCCACCCT<br>CTCCTGCAGGGCCAGTCAGAG<br>TGTTGATCAGCACTTAGCCTG<br>GTACCAGCAGAAACCTGGCC<br>AGGCTCCCAGGCTCCTCATCT<br>ACCAGGCAGCCACCAGGGCC<br>ACTGGTATCCCAGCCAGGTTC<br>AGTGGCAGTGGGTCTGGGAC<br>AGAGTTCACTCTCACCATCAG<br>CAGCCTGCAGTCTGAAGATTT<br>TGCAGTTTATTACTGTCAGCA<br>GTATCAGAACTGGCCTCTCAC<br>TTTCGGCGGAGGGACCAAGGT<br>GGAGATCAAACGAACGGTGG<br>CTGCACCATCTGTCTTCATCTT<br>CCCGCCATCTGATGAGCAGTT<br>GAAATCTGGAACTGCCTCTGT<br>TGTGTGCCTGCTGAATAACTT<br>CTATCCCAGAGAGGCCAAAG<br>TACAGTGGAAGGTGGATAAC<br>GCCCTCCAATCGGGTAACTCC<br>CAGGAGAGTGTCACAGAGCA<br>GGACAGCAAGGACAGCACCT<br>ACAGCCTCAGCAGCACCCTGA<br>CGCTGAGCAAAGCAGACTAC<br>GAGAAACACAAAGTCTACGC<br>CTGCGAAGTCACCCATCAGGG<br>CCTGAGCTCGCCCGTCACAAA<br>GAGCTTCAACAGGGGAGAGT<br>GT<br>(SEQ ID NO: 248) | CAGGTGCAGCTGGTGGAGTCTGGGGGAGGCGTGGTCCAGCC<br>TGGGAGGTCCCTGAGACTCTCCTGTGCAGCATCTGGATTCA<br>CCTTCCAGAACTATGGCATGCACTGGGTCCGCCAGGCTCCA<br>GGCGAGGGGCTGGAGTGGGTGGCAGCTATATGGTTTGATGC<br>GGCTTTCAAATACTATGCAGACGCCGTGAAGGGCCGATTCA<br>CCATCTCCAGAGACAACTCCAAGAACACGCTGTATCTGCAA<br>ATGAACAGCCTGAGAGCCGAGGACACGGCTGTGTATTACTG<br>TGCGAGAGATCTCGCGATTTTTGGAGTGGTCCCCGACTACT<br>GGGGCCAGGGAACCCTGGTCACCGTGTCTAGTGCCTCCACC<br>AAGGGCCCATCGGTCTTCCCCCTGGCACCCTCCTCCAAGAG<br>CACCTCTGGGGGCACAGCGGCCCTGGGCTGCCTGGTCAAGG<br>ACTACTTCCCCGAACCGGTGACGGTGTCGTGGAACTCAGGC<br>GCCCTGACCAGCGGCGTGCACACCTTCCCGGCTGTCCTACA<br>GTCCTCAGGACTCTACTCCCTCAGCAGCGTGGTGACCGTGC<br>CCTCCAGCAGCTTGGGCACCCAGACCTACATCTGCAACGTG<br>AATCACAAGCCCAGCAACACCAAGGTGGACAAGAAAGTTG<br>AGCCCAAATCTTGTGACAAAACTCACACATGCCCACCGTGC<br>CCAGCACCTGAACTCCTGGGGGGACCGTCAGTCTTCCTCTTC<br>CCCCCAAAACCCAAGGACACCCTCATGATCTCCCGGACCCC<br>TGAGGTCACATGCGTGGTGGTGGACGTGAGCCACGAAGACC<br>CTGAGGTCAAGTTCAACTGGTACGTGGACGGCGTGGAGGTG<br>CATAATGCCAAGACAAAGCCGTGCGAGGAGCAGTACGGCA<br>GCACGTACCGTTGCGTCAGCGTCCTCACCGTCCTGCACCAG<br>GACTGGCTGAATGGCAAGGAGTACAAGTGCAAGGTGTCCA<br>ACAAAGCCCTCCCAGCCCCCATCGAGAAAACCATCTCCAAA<br>GCCAAAGGGCAGCCCCGAGAACCACAGGTGTACACCCTGCC<br>CCCATCCCGGGAGGAGATGACCAAGAACCAGGTCAGCCTG<br>ACCTGCCTGGTCAAAGGCTTCTATCCCAGCGACATCGCCGT<br>GGAGTGGGAGAGCAATGGGCAGCCGGAGAACAACTACAAG<br>ACCACGCCTCCCGTGCTGGACTCCGACGGCTCCTTCTTCCTC<br>TATAGCAAGCTCACCGTGGACAAGAGCAGGTGGCAGCAGG<br>GGAACGTCTTCTCATGCTCCGTGATGCATGAGGCTCTGCAC<br>AACCACTACACGCAGAAGAGCCTCTCCCTGTCTCCGGGTAA<br>A<br>(SEQ ID NO: 249) |
| | | AA | EIVMTQSPATLSVSPGERATLS<br>CRASQSVDQHLAWYQQKPGQ<br>APRLLIYQAATRATGIPARFSGS<br>GSGTEFTLTISSLQSEDFAVYYC<br>QQYQNWPLTFGGGTKVEIKRT<br>VAAPSVFIFPPSDEQLKSGTASV<br>VCLLNNFYPREAKVQWKVDN<br>ALQSGNSQESVTEQDSKDSTYS<br>LSSTLTLSKADYEKHKVYACE<br>VTHQGLSSPVTKSFNRGEC<br>(SEQ ID NO: 250) | QVQLVESGGGVVQPGRSLRLSCAASGFTFQNYGMHWVRQAP<br>GEGLEWVAAIWFDAAFKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPCE<br>EQYGSTYRCVSVLTVLHQDWLNGKEYKCKVSNKALPAPIEKTI<br>SKAKGQPREPQVYTLPPSREEMTKNQVSLTCLVKGFYPSDIAV<br>EWESNGQPENNYKTTPPVLDSDGSFFLYSKLTVDKSRWQQGN<br>VFSCSVMHEALHNHYTQKSLSLSPGK<br>(SEQ ID NO: 251) |
| iPS: 529381 | | NA | ATGGACATGAGGGTGCCCGCT<br>CAGCTCCTGGGGCTCCTGCTG<br>CTGTGGCTGAGAGGTGCGCGC<br>TGTGAAATCGTGATGACGCAG<br>TCTCCAGCCACCCTGTCTGTG<br>TCTCCAGGGGAAAGAGCCAC<br>CCTCTCCTGCAGGGCCAGTCA<br>GAGTGTTAGCGAACACTTAGC<br>CTGGTACCAGCAGAAACCTG<br>GCCAGGCTCCCAGGCTCCTCA<br>TCTACGAAGCAGCCACCAGG<br>GCCACTGGTATCCCAGCCAGG<br>TTCAGTGGCAGTGGGTCTGGG<br>ACAGAGTTCACTCTCACCATC<br>AGCAGCCTGCAGTCTGAAGAT<br>TTTGCAGTTTATTACTGTCAG<br>CAGTATCAGAACTGGCCTCTC<br>ACTTTCGGCGGAGGGACCAA<br>GGTGGAGATCAAACGAACGG<br>TGGCTGCACCATCTGTCTTCA<br>TCTTCCCGCCATCTGATGAGC<br>AGTTGAAATCTGGAACTGCCT<br>CTGTTGTGTGCCTGCTGAATA<br>ACTTCTATCCCAGAGAGGCCA<br>AAGTACAGTGGAAGGTGGAT<br>AACGCCCTCCAATCGGGTAAC | ATGGACATGAGGGTGCCCGCTCAGCTCCTGGGGCTCCTGCT<br>GCTGTGGCTGAGAGGTGCGCGCTGTCAGGTGCAGCTGGTGG<br>AGTCTGGGGGAGGCGTGGTCCAGCCTGGGAGGTCCCTGAGA<br>CTCTCCTGTGCAGCATCTGGATTCACCTTCAGTAACTATGGC<br>ATGCACTGGGTCCGCCAGGCTCCAGGCGAGGGGCTGGAGTG<br>GGTGGCAGCTATCTGGTTTGATGCAAGTGATAAATACTATG<br>CAGACGCCGTGAAGGGCCGATTCACCATCTCCAGAGACAAC<br>TCCAAGAACACGCTGTATCTGCAAATGAACAGCCTGAGAGC<br>CGAGGACACGGCTGTGTATTACTGTGCGAGAGATCTGGCGA<br>TTTTTGGAGTGATTCCCGACTACTGGGGCCAGGGAACCCTG<br>GTCACCGTGTCTAGTGCCTCCACCAAGGGCCCATCGGTCTTC<br>CCCCTGGCACCCTCCTCCAAGAGCACCTCTGGGGGCACAGC<br>GGCCCTGGGCTGCCTGGTCAAGGACTACTTCCCCGAACCGG<br>TGACGGTGTCGTGGAACTCAGGCGCCCTGACCAGCGGCGTG<br>CACACCTTCCCGGCTGTCCTACAGTCCTCAGGACTCTACTCC<br>CTCAGCAGCGTGGTGACCGTGCCCTCCAGCAGCTTGGGCAC<br>CCAGACCTACATCTGCAACGTGAATCACAAGCCCAGCAACA<br>CCAAGGTGGACAAGAAAGTTGAGCCCAAATCTTGTGACAAA<br>ACTCACACATGCCCACCGTGCCCAGCACCTGAACTCCTGGG<br>GGGACCGTCAGTCTTCCTCTTCCCCCCAAAACCCAAGGACA<br>CCCTCTACATCACCCGGGAGCCTGAGGTCACATGCGTGGTG<br>GTGGACGTGAGCCACGAAGACCCTGAGGTCAAGTTCAACTG<br>GTACGTGGACGGCGTGGAGGTGCATAATGCCAAGACAAAG<br>CCGTGCGAGGAGCAGTACGGCAGCACGTACCGTTGCGTCAG<br>CGTCCTCACCGTCCTGCACCAGGACTGGCTGAATGGCAAGG<br>AGTACAAGTGCAAGGTGTCCAACAAAGCCCTCCCAGCCCCC |

TABLE 5-continued

Exemplary Light and Heavy Chain Nucleic Acid ("NA") and Amino Acid ("AA") Sequences

| Ab | Description | Type | LC | HC |
|---|---|---|---|---|
| | | | TCCCAGGAGAGTGTCACAGA GCAGGACAGCAAGGACAGCA CCTACAGCCTCAGCAGCACCC TGACGCTGAGCAAAGCAGAC TACGAGAAACACAAAGTCTA CGCCTGCGAAGTCACCCATCA GGGCCTGAGCTCGCCCGTCAC AAAGAGCTTCAACAGGGGAG AGTGT (SEQ ID NO: 1361 | ATCGAGAAAACCATCTCCAAAGCCAAAGGGCAGCCCCGAG AACCACAGGTGTACACCCTGCCCCCATCCCGGGAGGAGATG ACCAAGAACCAGGTCAGCCTGACCTGCCTGGTCAAAGGCTT CTATCCCAGCGATATCGCCGTGGAGTGGGAGAGCAATGGGC AGCCGGAGAACAACTACAAGACCACGCCTCCCGTGCTGGAC TCCGACGGCTCCTTCTTCCTCTATAGCAAGCTCACCGTGGAC AAGAGTAGGTGGCAGCAGGGGAACGTCTTCTCATGCTCCGT GATGCATGAGGCTCTGCACAACCACTACACGCAGAAGAGCC TCTCCCTGTCTCCGGGTAAA (SEQ ID NO: 1362 |
| | | AA | EIVMTQSPATLSVSPGERATLS CRASQSVSEHLAWYQQKPGQA PRLLIYEAATRATGIPARFSGSG SGTEFTLTISSLQSEDFAVYYCQ QYQNWPLTFGGGTKVEIKRTV AAPSVFIFPPSDEQLKSGTASVV CLLNNFYPREAKVQWKVDNAL QSGNSQESVTEQDSKDSTYSLS STLTLSKADYEKHKVYACEVT HQGLSSPVTKSFNRGEC (SEQ ID NO: 1288) | QVQLVESGGGVVQPGRSLRLSCAASGFTFSNYGMHWVRQAP GEGLEWVAAIWFDASDKYYADAVKGRFTISRDNSKNTLYLQ MNSLRAEDTAVYYCARDLAIFGVIPDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPSN TKVDKKVEPKSCDKTHTCPPCPAPELLGGPSVFLFPPKPKDTLY ITREPEVTCVVVDVSHEDPEVKFNWYVDGVEVHNAKTKPCEE QYGSTYRCVSVLTVLHQDWLNGKEYKCKVSNKALPAPIEKTIS KAKGQPREPQVYTLPPSREEMTKNQVSLTCLVKGFYPSDIAVE WESNGQPENNYKTTPPVLDSDGSFFLYSKLTVDKSRWQQGNV FSCSVMHEALHNHYTQKSLSLSPGK (SEQ ID NO: 1289) |
| iPS: 529382 | | NA | ATGGACATGAGGGTGCCCGCT CAGCTCCTGGGGCTCCTGCTG CTGTGGCTGAGAGGTGCGCGC TGTGAAATCGTGATGACGCAG TCTCCAGCCACCCTGTCTGTG TCTCCAGGGGAAAGAGCCAC CCTCTCCTGCAGGGCCAGTCA GAGTGTTAGCAGCAACTTAGC CTGGTACCAGCAGAAACCTG GCCAGGCTCCCAGGCTCCTCA TCTATGGTGCAGCCACCAGGG CCACTGGTATCCCAGCCAGGT TCAGTGGCAGTGGGTCTGGGA CAGAGTTCACTCTCACCATCA GCAGCCTGCAGTCTGAAGATT TTGCAGTTTATTACTGTCAGC AGTATAATAACTGGCCTCTCA CTTTCGGCGGAGGGACCAAG GTGGAGATCAAACGAACGGT GGCTGCACCATCTGTCTTCAT CTTCCCGCCATCTGATGAGCA GTTGAAATCTGGAACTGCCTC TGTTGTGTGCCTGCTGAATAA CTTCTATCCCAGAGAGGCCAA AGTACAGTGGAAGGTGGATA ACGCCCTCCAATCGGGTAACT CCCAGGAGAGTGTCACAGAG CAGGACAGCAAGGACAGCAC CTACAGCCTCAGCAGCACCCT GACGCTGAGCAAAGCAGACT ACGAGAAACACAAAGTCTAC GCCTGCGAAGTCACCCATCAG GGCCTGAGCTCGCCCGTCACA AAGAGCTTCAACAGGGGAGA GTGT (SEQ ID NO: 1363 | ATGGACATGAGGGTGCCCGCTCAGCTCCTGGGGCTCCTGCT GCTGTGGCTGAGAGGTGCGCGCTGTCAGGTGCAGCTGGTGG AGTCTGGGGGAGGCGTGGTCCAGCCTGGGAGGTCCCTGAGA CTCTCCTGTGCAGCATCTGGATTCACCTTCAGTAACTATGGC ATGCACTGGGTCCGCCAGGCTCCAGGCGAGGGGCTGGAGTG GGTGGCAGCTATCTGGTTTGATGCAAGTGATAAATACTATG CAGACGCCGTGAAGGGCCGATTCACCATCTCCAGAGACAAC TCCAAGAACACGCTGTATCTGCAAATGAACAGCCTGAGAGC CGAGGACACGGCTGTGTATTACTGTGCGAGAGATATTGCGA TTTTTGGAGTGGTCCCCGACTACTGGGGCCAGGGAACCCTG GTCACCGTGTCTAGTGCCTCCACCAAGGGCCCATCGGTCTTC CCCCTGGCACCCTCCTCCAAGAGCACCTCTGGGGGCACAGC GGCCCTGGGCTGCCTGGTCAAGGACTACTTCCCCGAACCGG TGACGGTGTCGTGGAACTCAGGCGCCCTGACCAGCGGCGTG CACACCTTCCCGGCTGTCCTACAGTCCTCAGGACTCTACTCC CTCAGCAGCGTGGTGACCGTGCCCTCCAGCAGCTTGGGCAC CCAGACCTACATCTGCAACGTGAATCACAAGCCCAGCAACA CCAAGGTGGACAAGAAAGTTGAGCCCAAATCTTGTGACAAA ACTCACACATGCCCACCGTGCCCAGCACCTGAACTCCTGGG GGGACCGTCAGTCTTCCTCTTCCCCCCAAAACCCAAGGACA CCCTCTACATCACCCGGGAGCCTGAGGTCACATGCGTGGTG GTGGACGTGAGCCACGAAGACCCTGAGGTCAAGTTCAACTG GTACGTGGACGGCGTGGAGGTGCATAATGCCAAGACAAAG CCGTGCGAGGAGCAGTACGGCAGCACGTACCGTTGCGTCAG CGTCCTCACCGTCCTGCACCAGGACTGGCTGAATGGCAAGG AGTACAAGTGCAAGGTGTCCAACAAAGCCCTCCCAGCCCCC ATCGAGAAAACCATCTCCAAAGCCAAAGGGCAGCCCCGAG AACCACAGGTGTACACCCTGCCCCCATCCCGGGAGGAGATG ACCAAGAACCAGGTCAGCCTGACCTGCCTGGTCAAAGGCTT CTATCCCAGCGATATCGCCGTGGAGTGGGAGAGCAATGGGC AGCCGGAGAACAACTACAAGACCACGCCTCCCGTGCTGGAC TCCGACGGCTCCTTCTTCCTCTATAGCAAGCTCACCGTGGAC AAGAGTAGGTGGCAGCAGGGGAACGTCTTCTCATGCTCCGT GATGCATGAGGCTCTGCACAACCACTACACGCAGAAGAGCC TCTCCCTGTCTCCGGGTAAA (SEQ ID NO: 1364 |
| | | AA | EIVMTQSPATLSVSPGERATLS CRASQSVSSNLAWYQQKPGQA PRLLIYGAATRATGIPARFSGSG SGTEFTLTISSLQSEDFAVYYCQ QYNNWPLTFGGGTKVEIKRTV AAPSVFIFPPSDEQLKSGTASVV CLLNNFYPREAKVQWKVDNAL QSGNSQESVTEQDSKDSTYSLS STLTLSKADYEKHKVYACEVT HQGLSSPVTKSFNRGEC (SEQ ID NO: 1299) | QVQLVESGGGVVQPGRSLRLSCAASGFTFSNYGMHWVRQAP GEGLEWVAAIWFDASDKYYADAVKGRFTISRDNSKNTLYLQ MNSLRAEDTAVYYCARDIAIFGVVPDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPSN TKVDKKVEPKSCDKTHTCPPCPAPELLGGPSVFLFPPKPKDTLY ITREPEVTCVVVDVSHEDPEVKFNWYVDGVEVHNAKTKPCEE QYGSTYRCVSVLTVLHQDWLNGKEYKCKVSNKALPAPIEKTIS KAKGQPREPQVYTLPPSREEMTKNQVSLTCLVKGFYPSDIAVE WESNGQPENNYKTTPPVLDSDGSFFLYSKLTVDKSRWQQGNV FSCSVMHEALHNHYTQKSLSLSPGK (SEQ ID NO: 1300) |

TABLE 5-continued

Exemplary Light and Heavy Chain Nucleic Acid ("NA") and Amino Acid ("AA") Sequences

| Ab | Description | Type | LC | HC |
|---|---|---|---|---|
| iPS: 529307 | 101 | NA | ATGGACATGAGGGTGCCCGCT<br>CAGCTCCTGGGGCTCCTGCTG<br>CTGTGGCTGAGAGGTGCGCGC<br>TGTGAAATCGTGCTGACGCAG<br>TCTCCAGCCACCCTGTCTCTG<br>TCTCCAGGGGAAAGAGCCAC<br>CCTCTCCTGCAGGGCCAGTCA<br>GAGTGTTAGCAGCAACTTAGC<br>CTGGTACCAGCAGAAACCTG<br>GCCAGGCTCCCAGGCTCCTCA<br>TCTATGGTGCAGCCACCAGGG<br>CCACTGGTATCCCAGACAGGT<br>TCAGTGGCAGTGGGTCTGGGA<br>CAGAGTTCACTCTCACCATCA<br>GCAGGCTGGAGCCTGAAGATT<br>TTGCAGTTTATTACTGTCAGC<br>AGTATAATAACTGGCCTCTCA<br>CTTTCGGCGGAGGGACCAAG<br>GTGGAGATCAAACGAACGGT<br>GGCTGCACCATCTGTCTTCAT<br>CTTCCCGCCATCTGATGAGCA<br>GTTGAAATCTGGAACTGCCTC<br>TGTTGTGTGCCTGCTGAATAA<br>CTTCTATCCCAGAGAGGCCAA<br>AGTACAGTGGAAGGTGGATA<br>ACGCCCTCCAATCGGGTAACT<br>CCCAGGAGAGTGTCACAGAG<br>CAGGACAGCAAGGACAGCAC<br>CTACAGCCTCAGCAGCACCCT<br>GACGCTGAGCAAAGCAGACT<br>ACGAGAAACACAAAGTCTAC<br>GCCTGCGAAGTCACCCATCAG<br>GGCCTGAGCTCGCCCGTCACA<br>AAGAGCTTCAACAGGGGAGA<br>GTGT<br>(SEQ ID NO: 1365 | ATGGACATGAGGGTGCCCGCTCAGCTCCTGGGGCTCCTGCT<br>GCTGTGGCTGAGAGGTGCGCGCTGTCAGGTGCAGCTGGTGG<br>AGTCTGGGGGAGGCGTGGTCCAGCCTGGGAGGTCCCTGAGA<br>CTCTCCTGTGCAGCATCTGGATTCACCTTCAGTAACTATGGC<br>ATGCACTGGGTCCGCCAGGCTCCAGGCGAGGGGCTGGAGTG<br>GGTGGCAGCTATCTGGTTTGATGCAAGTGATAAATACTATG<br>CAGACGCCGTGAAGGGCCGATTCACCATCTCCAGAGACAAC<br>TCCAAGAACACGCTGTATCTGCAAATGAACAGCCTGAGAGC<br>CGAGGACACGGCTGTGTATTACTGTGCGAGAGATCAGGCGA<br>TTTTTGGAGTGGTCCCCGATTACTGGGGCCAGGGAACCCTG<br>GTCACCGTGTCTAGTGCCTCCACCAAGGGCCCATCGGTCTTC<br>CCCCTGGCACCCTCCTCCAAGAGCACCTCTGGGGGCACAGC<br>GGCCCTGGGCTGCCTGGTCAAGGACTACTTCCCCGAACCGG<br>TGACGGTGTCGTGGAACTCAGGCGCCCTGACCAGCGGCGTG<br>CACACCTTCCCGGCTGTCCTACAGTCCTCAGGACTCTACTCC<br>CTCAGCAGCGTGGTGACCGTGCCCTCCAGCAGCTTGGGCAC<br>CCAGACCTACATCTGCAACGTGAATCACAAGCCCAGCAACA<br>CCAAGGTGGACAAGAAAGTTGAGCCCAAATCTTGTGACAAA<br>ACTCACACATGCCCACCGTGCCCAGCACCTGAACTCCTGGG<br>GGGACCGTCAGTCTTCCTCTTCCCCCCAAAACCCAAGGACA<br>CCCTCTACATCACCCGGGAGCCTGAGGTCACATGCGTGGTG<br>GTGGACGTGAGCCACGAAGACCCTGAGGTCAAGTTCAACTG<br>GTACGTGGACGGCGTGGAGGTGCATAATGCCAAGACAAAG<br>CCGTGCGAGGAGCAGTACGGCAGCACGTACCGTTGCGTCAG<br>CGTCCTCACCGTCCTGCACCAGGACTGGCTGAATGGCAAGG<br>AGTACAAGTGCAAGGTGTCCAACAAAGCCCTCCCAGCCCCC<br>ATCGAGAAAACCATCTCCAAAGCCAAAGGGCAGCCCCGAG<br>AACCACAGGTGTACACCCTGCCCCCATCCCGGGAGGAGATG<br>ACCAAGAACCAGGTCAGCCTGACCTGCCTGGTCAAAGGCTT<br>CTATCCCAGCGATATCGCCGTGGAGTGGGAGAGCAATGGGC<br>AGCCGGAGAACAACTACAAGACCACGCCTCCCGTGCTGGAC<br>TCCGACGGCTCCTTCTTCCTCTATAGCAAGCTCACCGTGGAC<br>AAGAGTAGGTGGCAGCAGGGGAACGTCTTCTCATGCTCCGT<br>GATGCATGAGGCTCTGCACAACCACTACACGCAGAAGAGCC<br>TCTCCCTGTCTCCGGGTAAA<br>(SEQ ID NO: 1366 |
| | | AA | EIVLTQSPATLSLSPGERATLSC<br>RASQSVSSNLAWYQQKPGQAP<br>RLLIYGAATRATGIPDRFSGSGS<br>GTEFTLTISRLEPEDFAVYYCQ<br>QYNNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 1309) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDQAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTLY<br>ITREPEVTCVVVDVSHEDPEVKFNWYVDGVEVHNAKTKPCEE<br>QYGSTYRCVSVLTVLHQDWLNGKEYKCKVSNKALPAPIEKTIS<br>KAKGQPREPQVYTLPPSREEMTKNQVSLTCLVKGFYPSDIAVE<br>WESNGQPENNYKTTPPVLDSDGSFFLYSKLTVDKSRWQQGNV<br>FSCSVMHEALHNHYTQKSLSLSPGK<br>(SEQ ID NO: 1310) |
| iPS: 529399 | | NA | ATGGACATGAGGGTGCCCGCT<br>CAGCTCCTGGGGCTCCTGCTG<br>CTGTGGCTGAGAGGTGCGCGC<br>TGTGAAATCGTGCTGACGCAG<br>TCTCCAGCCACCCTGTCTCTG<br>TCTCCAGGGGAAAGAGCCAC<br>CCTCTCCTGCAGGGCCAGTCA<br>GAGTGTTAGCGAACACTTAGC<br>CTGGTACCAGCAGAAACCTG<br>GCCAGGCTCCCAGGCTCCTCA<br>TCTACGAAGCAGCCACCAGG<br>GCCACTGGTATCCCAGACAGG<br>TTCAGTGGCAGTGGGTCTGGG<br>ACAGAGTTCACTCTCACCATC<br>AGCAGGCTGGAGCCTGAAGA<br>TTTTGCAGTTTATTACTGTCAG<br>CAGTATCAGAACTGGCCTCTC<br>ACTTTCGGCGGAGGGACCAA<br>GGTGGAGATCAAACGAACGG<br>TGGCTGCACCATCTGTCTTCA<br>TCTTCCCGCCATCTGATGAGC<br>AGTTGAAATCTGGAACTGCCT<br>CTGTTGTGTGCCTGCTGAATA<br>ACTTCTATCCCAGAGAGGCCA<br>AAGTACAGTGGAAGGTGGAT | ATGGACATGAGGGTGCCCGCTCAGCTCCTGGGGCTCCTGCT<br>GCTGTGGCTGAGAGGTGCGCGCTGTCAGGTGCAGCTGGTGG<br>AGTCTGGGGGAGGCGTGGTCCAGCCTGGGAGGTCCCTGAGA<br>CTCTCCTGTGCAGCATCTGGATTCACCTTCAGTAACTATGGC<br>ATGCACTGGGTCCGCCAGGCTCCAGGCGAGGGGCTGGAGTG<br>GGTGGCAGCTATCTGGTTTGATGCAAGTGATAAATACTATG<br>CAGACGCCGTGAAGGGCCGATTCACCATCTCCAGAGACAAC<br>TCCAAGAACACGCTGTATCTGCAAATGAACAGCCTGAGAGC<br>CGAGGACACGGCTGTGTATTACTGTGCGAGAGATCTGGCGA<br>TTTTTGGAGTGATTCCCGACTACTGGGGCCAGGGAACCCTG<br>GTCACCGTGTCTAGTGCCTCCACCAAGGGCCCATCGGTCTTC<br>CCCCTGGCACCCTCCTCCAAGAGCACCTCTGGGGGCACAGC<br>GGCCCTGGGCTGCCTGGTCAAGGACTACTTCCCCGAACCGG<br>TGACGGTGTCGTGGAACTCAGGCGCCCTGACCAGCGGCGTG<br>CACACCTTCCCGGCTGTCCTACAGTCCTCAGGACTCTACTCC<br>CTCAGCAGCGTGGTGACCGTGCCCTCCAGCAGCTTGGGCAC<br>CCAGACCTACATCTGCAACGTGAATCACAAGCCCAGCAACA<br>CCAAGGTGGACAAGAAAGTTGAGCCCAAATCTTGTGACAAA<br>ACTCACACATGCCCACCGTGCCCAGCACCTGAACTCCTGGG<br>GGGACCGTCAGTCTTCCTCTTCCCCCCAAAACCCAAGGACA<br>CCCTCTACATCACCCGGGAGCCTGAGGTCACATGCGTGGTG<br>GTGGACGTGAGCCACGAAGACCCTGAGGTCAAGTTCAACTG<br>GTACGTGGACGGCGTGGAGGTGCATAATGCCAAGACAAAG<br>CCGTGCGAGGAGCAGTACGGCAGCACGTACCGTTGCGTCAG<br>CGTCCTCACCGTCCTGCACCAGGACTGGCTGAATGGCAAGG |

TABLE 5-continued

| Exemplary Light and Heavy Chain Nucleic Acid ("NA") and Amino Acid ("AA") Sequences | | | | |
|---|---|---|---|---|
| Ab | Description | Type | LC | HC |
| | | | AACGCCCTCCAATCGGGTAAC<br>TCCCAGGAGAGTGTCACAGA<br>GCAGGACAGCAAGGACAGCA<br>CCTACAGCCTCAGCAGCACCC<br>TGACGCTGAGCAAAGCAGAC<br>TACGAGAAACACAAAGTCTA<br>CGCCTGCGAAGTCACCCATCA<br>GGGCCTGAGCTCGCCCGTCAC<br>AAAGAGCTTCAACAGGGGAG<br>AGTGT<br>(SEQ ID NO: 1367 | AGTACAAGTGCAAGGTGTCCAACAAAGCCCTCCCAGCCCCC<br>ATCGAGAAAACCATCTCCAAAGCCAAAGGGCAGCCCCGAG<br>AACCACAGGTGTACACCCTGCCCCCATCCCGGGAGGAGATG<br>ACCAAGAACCAGGTCAGCCTGACCTGCCTGGTCAAAGGCTT<br>CTATCCCAGCGATATCGCCGTGGAGTGGGAGAGCAATGGGC<br>AGCCGGAGAACAACTACAAGACCACGCCTCCCGTGCTGGAC<br>TCCGACGGCTCCTTCTTCCTCTATAGCAAGCTCACCGTGGAC<br>AAGAGTAGGTGGCAGCAGGGGAACGTCTTCTCATGCTCCGT<br>GATGCATGAGGCTCTGCACAACCACTACACGCAGAAGAGCC<br>TCTCCCTGTCTCCGGGTAAA<br>(SEQ ID NO: 1368 |
| | | AA | EIVLTQSPATLSLSPGERATLSC<br>RASQSVSEHLAWYQQKPGQAP<br>RLLIYEAATRATGIPDRFSGSGS<br>GTEFTLTISRLEPEDFAVYYCQ<br>QYQNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 1319) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVIPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTLY<br>ITREPEVTCVVVDVSHEDPEVKFNWYVDGVEVHNAKTKPCEE<br>QYGSTYRCVSVLTVLHQDWLNGKEYKCKVSNKALPAPIEKTIS<br>KAKGQPREPQVYTLPPSREEMTKNQVSLTCLVKGFYPSDIAVE<br>WESNGQPENNYKTTPPVLDSDGSFFLYSKLTVDKSRWQQGNV<br>FSCSVMHEALHNHYTQKSLSLSPGK<br>(SEQ ID NO: 1320) |
| iPS: 529400 | | NA | ATGGACATGAGGGTGCCCGCT<br>CAGCTCCTGGGGCTCCTGCTG<br>CTGTGGCTGAGAGGTGCGCGC<br>TGTGAAATCGTGCTGACGCAG<br>TCTCCAGCCACCCTGTCTCTG<br>TCTCCAGGGGAAAGAGCCAC<br>CCTCTCCTGCAGGGCCAGTCA<br>GAGTGTTAGCAGCAACTTAGC<br>CTGGTACCAGCAGAAACCTG<br>GCCAGGCTCCCAGGCTCCTCA<br>TCTATGGTGCAGCCACCAGGG<br>CCACTGGTATCCCAGACAGGT<br>TCAGTGGCAGTGGGTCTGGGA<br>CAGAGTTCACTCTCACCATCA<br>GCAGGCTGGAGCCTGAAGATT<br>TTGCAGTTTATTACTGTCAGC<br>AGTATAATAACTGGCCTCTCA<br>CTTTCGGCGGAGGGACCAAG<br>GTGGAGATCAAACGAACGGT<br>GGCTGCACCATCTGTCTTCAT<br>CTTCCCGCCATCTGATGAGCA<br>GTTGAAATCTGGAACTGCCTC<br>TGTTGTGTGCCTGCTGAATAA<br>CTTCTATCCCAGAGAGGCCAA<br>AGTACAGTGGAAGGTGGATA<br>ACGCCCTCCAATCGGGTAACT<br>CCCAGGAGAGTGTCACAGAG<br>CAGGACAGCAAGGACAGCAC<br>CTACAGCCTCAGCAGCACCCT<br>GACGCTGAGCAAAGCAGACT<br>ACGAGAAACACAAAGTCTAC<br>GCCTGCGAAGTCACCCATCAG<br>GGCCTGAGCTCGCCCGTCACA<br>AAGAGCTTCAACAGGGGAGA<br>GTGT<br>(SEQ ID NO: 1369 | ATGGACATGAGGGTGCCCGCTCAGCTCCTGGGGCTCCTGCT<br>GCTGTGGCTGAGAGGTGCGCGCTGTCAGGTGCAGCTGGTGG<br>AGTCTGGGGGAGGCGTGGTCCAGCCTGGGAGGTCCCTGAGA<br>CTCTCCTGTGCAGCATCTGGATTCACCTTCAGTAACTATGGC<br>ATGCACTGGGTCCGCCAGGCTCCAGGCGAGGGGCTGGAGTG<br>GGTGGCAGCTATCTGGTTTGATGCAAGTGATAAATACTATG<br>CAGACGCCGTGAAGGGCCGATTCACCATCTCCAGAGACAAC<br>TCCAAGAACACGCTGTATCTGCAAATGAACAGCCTGAGAGC<br>CGAGGACACGGCTGTGTATTACTGTGCGAGAGATATTGCGA<br>TTTTTGGAGTGGTCCCCGACTACTGGGGCCAGGGAACCCTG<br>GTCACCGTGTCTAGTGCCTCCACCAAGGGCCCATCGGTCTTC<br>CCCCTGGCACCCTCCTCCAAGAGCACCTCTGGGGGCACAGC<br>GGCCCTGGGCTGCCTGGTCAAGGACTACTTCCCCGAACCGG<br>TGACGGTGTCGTGGAACTCAGGCGCCCTGACCAGCGGCGTG<br>CACACCTTCCCGGCTGTCCTACAGTCCTCAGGACTCTACTCC<br>CTCAGCAGCGTGGTGACCGTGCCCTCCAGCAGCTTGGGCAC<br>CCAGACCTACATCTGCAACGTGAATCACAAGCCCAGCAACA<br>CCAAGGTGGACAAGAAAGTTGAGCCCAAATCTTGTGACAAA<br>ACTCACACATGCCCACCGTGCCCAGCACCTGAACTCCTGGG<br>GGGACCGTCAGTCTTCCTCTTCCCCCCAAAACCCAAGGACA<br>CCCTCATCATCACCCGGGAGCCTGAGGTCACATGCGTGGTG<br>GTGGACGTGAGCCACGAAGACCCTGAGGTCAAGTTCAACTG<br>GTACGTGGACGGCGTGGAGGTGCATAATGCCAAGACAAAG<br>CCGTGCGAGGAGCAGTACGGCAGCACGTACCGTTGCGTCAG<br>CGTCCTCACCGTCCTGCACCAGGACTGGCTGAATGGCAAGG<br>AGTACAAGTGCAAGGTGTCCAACAAAGCCCTCCCAGCCCCC<br>ATCGAGAAAACCATCTCCAAAGCCAAAGGGCAGCCCCGAG<br>AACCACAGGTGTACACCCTGCCCCCATCCCGGGAGGAGATG<br>ACCAAGAACCAGGTCAGCCTGACCTGCCTGGTCAAAGGCTT<br>CTATCCCAGCGATATCGCCGTGGAGTGGGAGAGCAATGGGC<br>AGCCGGAGAACAACTACAAGACCACGCCTCCCGTGCTGGAC<br>TCCGACGGCTCCTTCTTCCTCTATAGCAAGCTCACCGTGGAC<br>AAGAGTAGGTGGCAGCAGGGGAACGTCTTCTCATGCTCCGT<br>GATGCATGAGGCTCTGCACAACCACTACACGCAGAAGAGCC<br>TCTCCCTGTCTCCGGGTAAA<br>(SEQ ID NO: 1370 |
| | | AA | EIVLTQSPATLSLSPGERATLSC<br>RASQSVSSNLAWYQQKPGQAP<br>RLLIYGAATRATGIPDRFSGSGS<br>GTEFTLTISRLEPEDFAVYYCQ<br>QYNNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 1329) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDIAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTLY<br>ITREPEVTCVVVDVSHEDPEVKFNWYVDGVEVHNAKTKPCEE<br>QYGSTYRCVSVLTVLHQDWLNGKEYKCKVSNKALPAPIEKTIS<br>KAKGQPREPQVYTLPPSREEMTKNQVSLTCLVKGFYPSDIAVE<br>WESNGQPENNYKTTPPVLDSDGSFFLYSKLTVDKSRWQQGNV<br>FSCSVMHEALHNHYTQKSLSLSPGK<br>(SEQ ID NO: 1230) |

TABLE 5-continued

Exemplary Light and Heavy Chain Nucleic Acid ("NA") and Amino Acid ("AA") Sequences

| Ab | Description | Type | LC | HC |
|---|---|---|---|---|
| iPS: 5293403 | | NA | ATGGACATGAGGGTGCCCGCT<br>CAGCTCCTGGGGCTCCTGCTG<br>CTGTGGCTGAGAGGTGCGCGC<br>TGTGAAATCGTGCTGACGCAG<br>TCTCCAGCCACCCTGTCTCTG<br>TCTCCAGGGGAAAGAGCCAC<br>CCTCTCCTGCAGGGCCAGTCA<br>GAGTGTTGATCTGCACTTAGC<br>CTGGTACCAGCAGAAACCTG<br>GCCAGGCTCCCAGGCTCCTCA<br>TCTACGAAGCAGCCACCAGG<br>GCCACTGGTATCCCAGACAGG<br>TTCAGTGGCAGTGGGTCTGGG<br>ACAGAGTTCACTCTCACCATC<br>AGCAGGCTGGAGCCTGAAGA<br>TTTTGCAGTTTATTACTGTCAG<br>CAGTATCAGAACTGGCCTCTC<br>ACTTTCGGCGGAGGGACCAA<br>GGTGGAGATCAAACGAACGG<br>TGGCTGCACCATCTGTCTTCA<br>TCTTCCCGCCATCTGATGAGC<br>AGTTGAAATCTGGAACTGCCT<br>CTGTTGTGTGCCTGCTGAATA<br>ACTTCTATCCCAGAGAGGCCA<br>AAGTACAGTGGAAGGTGGAT<br>AACGCCCTCCAATCGGGTAAC<br>TCCCAGGAGAGTGTCACAGA<br>GCAGGACAGCAAGGACAGCA<br>CCTACAGCCTCAGCAGCACCC<br>TGACGCTGAGCAAAGCAGAC<br>TACGAGAAACACAAAGTCTA<br>CGCCTGCGAAGTCACCCATCA<br>GGGCCTGAGCTCGCCCGTCAC<br>AAAGAGCTTCAACAGGGGAG<br>AGTGT<br>(SEQ ID NO: 1371 | ATGGACATGAGGGTGCCCGCTCAGCTCCTGGGGCTCCTGCT<br>GCTGTGGCTGAGAGGTGCGCGCTGTCAGGTGCAGCTGGTGG<br>AGTCTGGGGGAGGCGTGGTCCAGCCTGGGAGGTCCCTGAGA<br>CTCTCCTGTGCAGCATCTGGATTCACCTTCAGTAACTATGGC<br>ATGCACTGGGTCCGCCAGGCTCCAGGCGAGGGGCTGGAGTG<br>GGTGGCAGCTATCTGGTTTGATGCAAGTGATAAATACTATG<br>CAGACGCCGTGAAGGGCCGATTCACCATCTCCAGAGACAAC<br>TCCAAGAACACGCTGTATCTGCAAATGAACAGCCTGAGAGC<br>CGAGGACACGGCTGTGTATTACTGTGCGAGAGATTTGGCGA<br>TTTTTGGAGTGGTCCCCGACTACTGGGGCCAGGGAACCCTG<br>GTCACCGTGTCTAGTGCCTCCACCAAGGGCCCATCGGTCTTC<br>CCCCTGGCACCCTCCTCCAAGAGCACCTCTGGGGGCACAGC<br>GGCCCTGGGCTGCCTGGTCAAGGACTACTTCCCCGAACCGG<br>TGACGGTGTCGTGGAACTCAGGCGCCCTGACCAGCGGCGTG<br>CACACCTTCCCGGCTGTCCTACAGTCCTCAGGACTCTACTCC<br>CTCAGCAGCGTGGTGACCGTGCCCTCCAGCAGCTTGGGCAC<br>CCAGACCTACATCTGCAACGTGAATCACAAGCCCAGCAACA<br>CCAAGGTGGACAAGAAAGTTGAGCCCAAATCTTGTGACAAA<br>ACTCACACATGCCCACCGTGCCCAGCACCTGAACTCCTGGG<br>GGGACCGTCAGTCTTCCTCTTCCCCCCAAAACCCAAGGACA<br>CCCTCTACATCACCCGGGAGCCTGAGGTCACATGCGTGGTG<br>GTGGACGTGAGCCACGAAGACCCTGAGGTCAAGTTCAACTG<br>GTACGTGGACGGCGTGGAGGTGCATAATGCCAAGACAAAG<br>CCGTGCGAGGAGCAGTACGGCAGCACGTACCGTTGCGTCAG<br>CGTCCTCACCGTCCTGCACCAGGACTGGCTGAATGGCAAGG<br>AGTACAAGTGCAAGGTGTCCAACAAAGCCCTCCCAGCCCCC<br>ATCGAGAAAACCATCTCCAAAGCCAAAGGGCAGCCCCGAG<br>AACCACAGGTGTACACCCTGCCCCCATCCCGGGAGGAGATG<br>ACCAAGAACCAGGTCAGCCTGACCTGCCTGGTCAAAGGCTT<br>CTATCCCAGCGATATCGCCGTGGAGTGGGAGAGCAATGGGC<br>AGCCGGAGAACAACTACAAGACCACGCCTCCCGTGCTGGAC<br>TCCGACGGCTCCTTCTTCCTCTATAGCAAGCTCACCGTGGAC<br>AAGAGTAGGTGGCAGCAGGGGAACGTCTTCTCATGCTCCGT<br>GATGCATGAGGCTCTGCACAACCACTACACGCAGAAGAGCC<br>TCTCCCTGTCTCCGGGTAAA<br>(SEQ ID NO: 1372 |
| | | AA | EIVLTQSPATLSLSPGERATLSC<br>RASQSVDLHLAWYQQKPGQAP<br>RLLIYEAATRATGIPDRFSGSGS<br>GTEFTLTISRLEPEDFAVYYCQ<br>QYQNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 1339) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTLY<br>ITREPEVTCVVVDVSHEDPEVKFNWYVDGVEVHNAKTKPCEE<br>QYGSTYRCVSVLTVLHQDWLNGKEYKCKVSNKALPAPIEKTIS<br>KAKGQPREPQVYTLPPSREEMTKNQVSLTCLVKGFYPSDIAVE<br>WESNGQPENNYKTTPPVLDSDGSFFLYSKLTVDKSRWQQGNV<br>FSCSVMHEALHNHYTQKSLSLSPGK<br>(SEQ ID NO: 1340) |
| iPS: 529404 | | NA | ATGGACATGAGGGTGCCCGCT<br>CAGCTCCTGGGGCTCCTGCTG<br>CTGTGGCTGAGAGGTGCGCGC<br>TGTGAAATCGTGCTGACGCAG<br>TCTCCAGCCACCCTGTCTCTG<br>TCTCCAGGGGAAAGAGCCAC<br>CCTCTCCTGCAGGGCCAGTCA<br>GAGTGTTAACCTGAACTTAGC<br>CTGGTACCAGCAGAAACCTG<br>GCCAGGCTCCCAGGCTCCTCA<br>TCTACCAGGCAGCCACCAGG<br>GCCACTGGTATCCCAGACAGG<br>TTCAGTGGCAGTGGGTCTGGG<br>ACAGAGTTCACTCTCACCATC<br>AGCAGGCTGGAGCCTGAAGA<br>TTTTGCAGTTTATTACTGTCAG<br>CAGTATAACCAGTGGCCTCTC<br>ACTTTCGGCGGAGGGACCAA<br>GGTGGAGATCAAACGAACGG<br>TGGCTGCACCATCTGTCTTCA<br>TCTTCCCGCCATCTGATGAGC<br>AGTTGAAATCTGGAACTGCCT<br>CTGTTGTGTGCCTGCTGAATA<br>ACTTCTATCCCAGAGAGGCCA<br>AAGTACAGTGGAAGGTGGAT | ATGGACATGAGGGTGCCCGCTCAGCTCCTGGGGCTCCTGCT<br>GCTGTGGCTGAGAGGTGCGCGCTGTCAGGTGCAGCTGGTGG<br>AGTCTGGGGGAGGCGTGGTCCAGCCTGGGAGGTCCCTGAGA<br>CTCTCCTGTGCAGCATCTGGATTCACCTTCAGTAACTATGGC<br>ATGCACTGGGTCCGCCAGGCTCCAGGCGAGGGGCTGGAGTG<br>GGTGGCAGCTATCTGGTTTGATGCAAGTGATAAATACTATG<br>CAGACGCCGTGAAGGGCCGATTCACCATCTCCAGAGACAAC<br>TCCAAGAACACGCTGTATCTGCAAATGAACAGCCTGAGAGC<br>CGAGGACACGGCTGTGTATTACTGTGCGAGAGATTTGGCGA<br>TTTTTGGAGTGGTCCCCGACTACTGGGGCCAGGGAACCCTG<br>GTCACCGTGTCTAGTGCCTCCACCAAGGGCCCATCGGTCTTC<br>CCCCTGGCACCCTCCTCCAAGAGCACCTCTGGGGGCACAGC<br>GGCCCTGGGCTGCCTGGTCAAGGACTACTTCCCCGAACCGG<br>TGACGGTGTCGTGGAACTCAGGCGCCCTGACCAGCGGCGTG<br>CACACCTTCCCGGCTGTCCTACAGTCCTCAGGACTCTACTCC<br>CTCAGCAGCGTGGTGACCGTGCCCTCCAGCAGCTTGGGCAC<br>CCAGACCTACATCTGCAACGTGAATCACAAGCCCAGCAACA<br>CCAAGGTGGACAAGAAAGTTGAGCCCAAATCTTGTGACAAA<br>ACTCACACATGCCCACCGTGCCCAGCACCTGAACTCCTGGG<br>GGGACCGTCAGTCTTCCTCTTCCCCCCAAAACCCAAGGACA<br>CCCTCTACATCACCCGGGAGCCTGAGGTCACATGCGTGGTG<br>GTGGACGTGAGCCACGAAGACCCTGAGGTCAAGTTCAACTG<br>GTACGTGGACGGCGTGGAGGTGCATAATGCCAAGACAAAG<br>CCGTGCGAGGAGCAGTACGGCAGCACGTACCGTTGCGTCAG<br>CGTCCTCACCGTCCTGCACCAGGACTGGCTGAATGGCAAGG |

TABLE 5-continued

Exemplary Light and Heavy Chain Nucleic Acid ("NA") and Amino Acid ("AA") Sequences

| Ab | Description | Type | LC | HC |
|---|---|---|---|---|
| | | | AACGCCCTCCAATCGGGTAAC<br>TCCCAGGAGAGTGTCACAGA<br>GCAGGACAGCAAGGACAGCA<br>CCTACAGCCTCAGCAGCACCC<br>TGACGCTGAGCAAAGCAGAC<br>TACGAGAAACACAAAGTCTA<br>CGCCTGCGAAGTCACCCATCA<br>GGGCCTGAGCTCGCCCGTCAC<br>AAAGAGCTTCAACAGGGGAG<br>AGTGT<br>(SEQ ID NO: 1373 | AGTACAAGTGCAAGGTGTCCAACAAAGCCCTCCCAGCCCCC<br>ATCGAGAAAACCATCTCCAAAGCCAAAGGGCAGCCCCGAG<br>AACCACAGGTGTACACCCTGCCCCCATCCCGGGAGGAGATG<br>ACCAAGAACCAGGTCAGCCTGACCTGCCTGGTCAAAGGCTT<br>CTATCCCAGCGATATCGCCGTGGAGTGGGAGAGCAATGGGC<br>AGCCGGAGAACAACTACAAGACCACGCCTCCCGTGCTGGAC<br>TCCGACGGCTCCTTCTTCCTCTATAGCAAGCTCACCGTGGAC<br>AAGAGTAGGTGGCAGCAGGGGAACGTCTTCTCATGCTCCGT<br>GATGCATGAGGCTCTGCACAACCACTACACGCAGAAGAGCC<br>TCTCCCTGTCTCCGGGTAAA<br>(SEQ ID NO: 1374 |
| | | AA | EIVLTQSPATLSLSPGERATLSC<br>RASQSVNLNLAWYQQKPGQAP<br>RLLIYQAATRATGIPDRFSGSGS<br>GTEFTLTISRLEPEDFAVYYCQ<br>QYNQWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 1349) | QVQLVESGGGVVQPGRSLRLSCAASGFTFSNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTLY<br>ITREPEVTCVVVDVSHEDPEVKFNWYVDGVEVHNAKTKPCEE<br>QYGSTYRCVSVLTVLHQDWLNGKEYKCKVSNKALPAPIEKTIS<br>KAKGQPREPQVYTLPPSREEMTKNQVSLTCLVKGFYPSDIAVE<br>WESNGQPENNYKTTPPVLDSDGSFFLYSKLTVDKSRWQQGNV<br>FSCSVMHEALHNHYTQKSLSLSPGK<br>(SEQ ID NO: 1350) |
| iPS:529405 | | NA | ATGGACATGAGGGTGCCCGCT<br>CAGCTCCTGGGGCTCCTGCTG<br>CTGTGGCTGAGAGGTGCGCGC<br>TGTGAAATCGTGCTGACGCAG<br>TCTCCAGCCACCCTGTCTCTG<br>TCTCCAGGGGAAAGAGCCAC<br>CCTCTCCTGCAGGGCCAGTCA<br>GAGTGTTTTCAGCCACTTAGC<br>CTGGTACCAGCAGAAACCTG<br>GCCAGGCTCCCAGGCTCCTCA<br>TCTACGAAGCAGCCACCAGG<br>GCCACTGGTATCCCAGACAGG<br>TTCAGTGGCAGTGGGTCTGGG<br>ACAGAGTTCACTCTCACCATC<br>AGCAGGCTGGAGCCTGAAGA<br>TTTTGCAGTTTATTACTGTCAG<br>CAGTATCAGAACTGGCCTCTC<br>ACTTTCGGCGGAGGGACCAA<br>GGTGGAGATCAAACGAACGG<br>TGGCTGCACCATCTGTCTTCA<br>TCTTCCCGCCATCTGATGAGC<br>AGTTGAAATCTGGAACTGCCT<br>CTGTTGTGTGCCTGCTGAATA<br>ACTTCTATCCCAGAGAGGCCA<br>AAGTACAGTGGAAGGTGGAT<br>AACGCCCTCCAATCGGGTAAC<br>TCCCAGGAGAGTGTCACAGA<br>GCAGGACAGCAAGGACAGCA<br>CCTACAGCCTCAGCAGCACCC<br>TGACGCTGAGCAAAGCAGAC<br>TACGAGAAACACAAAGTCTA<br>CGCCTGCGAAGTCACCCATCA<br>GGGCCTGAGCTCGCCCGTCAC<br>AAAGAGCTTCAACAGGGGAG<br>AGTGT<br>(SEQ ID NO: 1375 | ATGGACATGAGGGTGCCCGCTCAGCTCCTGGGGCTCCTGCT<br>GCTGTGGCTGAGAGGTGCGCGCTGTCAGGTGCAGCTGGTGG<br>AGTCTGGGGGAGGCGTGGTCCAGCCTGGGAGGTCCCTGAGA<br>CTCTCCTGTGCAGCATCTGGATTCACCTTCCAGAACTATGGC<br>ATGCACTGGGTCCGCCAGGCTCCAGGCGAGGGGCTGGAGTG<br>GGTGGCAGCTATCTGGTTTGATGCGTCTGACAAATACTATG<br>CAGACGCCGTGAAGGGCCGATTCACCATCTCCAGAGACAAC<br>TCCAAGAACACGCTGTATCTGCAAATGAACAGCCTGAGAGC<br>CGAGGACACGGCTGTGTATTACTGTGCGAGAGATCTTGCGA<br>TTTTTGGAGTGGTCCCCGACTACTGGGGCCAGGGAACCCTG<br>GTCACCGTGTCTAGTGCCTCCACCAAGGGCCCATCGGTCTTC<br>CCCCTGGCACCCTCCTCCAAGAGCACCTCTGGGGGCACAGC<br>GGCCCTGGGCTGCCTGGTCAAGGACTACTTCCCCGAACCGG<br>TGACGGTGTCGTGGAACTCAGGCGCCCTGACCAGCGGCGTG<br>CACACCTTCCCGGCTGTCCTACAGTCCTCAGGACTCTACTCC<br>CTCAGCAGCGTGGTGACCGTGCCCTCCAGCAGCTTGGGCAC<br>CCAGACCTACATCTGCAACGTGAATCACAAGCCCAGCAACA<br>CCAAGGTGGACAAGAAAGTTGAGCCCAAATCTTGTGACAAA<br>ACTCACACATGCCCACCGTGCCCAGCACCTGAACTCCTGGG<br>GGGACCGTCAGTCTTCCTCTTCCCCCCAAAACCCAAGGACA<br>CCCTCTACATCACCCGGGAGCCTGAGGTCACATGCGTGGTG<br>GTGGACGTGAGCCACGAAGACCCTGAGGTCAAGTTCAACTG<br>GTACGTGGACGGCGTGGAGGTGCATAATGCCAAGACAAAG<br>CCGTGCGAGGAGCAGTACGGCAGCACGTACCGTTGCGTCAG<br>CGTCCTCACCGTCCTGCACCAGGACTGGCTGAATGGCAAGG<br>AGTACAAGTGCAAGGTGTCCAACAAAGCCCTCCCAGCCCCC<br>ATCGAGAAAACCATCTCCAAAGCCAAAGGGCAGCCCCGAG<br>AACCACAGGTGTACACCCTGCCCCCATCCCGGGAGGAGATG<br>ACCAAGAACCAGGTCAGCCTGACCTGCCTGGTCAAAGGCTT<br>CTATCCCAGCGATATCGCCGTGGAGTGGGAGAGCAATGGGC<br>AGCCGGAGAACAACTACAAGACCACGCCTCCCGTGCTGGAC<br>TCCGACGGCTCCTTCTTCCTCTATAGCAAGCTCACCGTGGAC<br>AAGAGTAGGTGGCAGCAGGGGAACGTCTTCTCATGCTCCGT<br>GATGCATGAGGCTCTGCACAACCACTACACGCAGAAGAGCC<br>TCTCCCTGTCTCCGGGTAAA<br>(SEQ ID NO: 1376 |
| | | AA | EIVLTQSPATLSLSPGERATLSC<br>RASQSVFSHLAWYQQKPGQAP<br>RLLIYEAATRATGIPDRFSGSGS<br>GTEFTLTISRLEPEDFAVYYCQ<br>QYQNWPLTFGGGTKVEIKRTV<br>AAPSVFIFPPSDEQLKSGTASVV<br>CLLNNFYPREAKVQWKVDNAL<br>QSGNSQESVTEQDSKDSTYSLS<br>STLTLSKADYEKHKVYACEVT<br>HQGLSSPVTKSFNRGEC<br>(SEQ ID NO: 1359) | QVQLVESGGGVVQPGRSLRLSCAASGFTFQNYGMHWVRQAP<br>GEGLEWVAAIWFDASDKYYADAVKGRFTISRDNSKNTLYLQ<br>MNSLRAEDTAVYYCARDLAIFGVVPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTLY<br>ITREPEVTCVVVDVSHEDPEVKFNWYVDGVEVHNAKTKPCEE<br>QYGSTYRCVSVLTVLHQDWLNGKEYKCKVSNKALPAPIEKTIS<br>KAKGQPREPQVYTLPPSREEMTKNQVSLTCLVKGFYPSDIAVE<br>WESNGQPENNYKTTPPVLDSDGSFFLYSKLTVDKSRWQQGNV<br>FSCSVMHEALHNHYTQKSLSLSPGK<br>(SEQ ID NO: 1360) |

In one embodiment the antibody or fragment thereof comprises a light chain variable region comprising a sequence selected from the group consisting of SEQ ID NOs: 723, 727, 731, 735, 739, 743, 747, 751, 755, 759, 763, 767, 771, 775, 779, 783, 787, 791, 795, 799, 803, 807, 811, 815, 819, 823, 827, 831, 835, 839, 843, 847, 851, 855, 859, 863, 867, 871, 875, 879, 883, 887, 891, 895, 899, 903, 907, 911, 915, 919, 923, 927, 931, 935, 939, 943, 947, 951, 955, 959, 1286, 1296, 1306, 1316, 1326, 1336, 1346, and 1356. In one embodiment the antibody or fragment thereof comprises a heavy chain variable region comprising a sequence selected from the group consisting of SEQ ID NOs: 724, 728, 732, 736, 740, 744, 748, 752, 756, 760, 764, 768, 772, 776, 780, 784, 788, 792, 796, 800, 804, 808, 812, 816, 820, 824, 828, 832, 836, 840, 844, 848, 852, 856, 860, 864, 868, 872, 876, 880, 884, 888, 892, 896, 900, 904, 908, 912, 916, 920, 924, 928, 932, 936, 940, 944, 948, 952, 956, 960, 1287, 1297, 1307, 1317, 1327, 1337, 1347, and 1357. In one embodiment the antibody or fragment thereof comprises a light chain variable region comprising a sequence selected from the group consisting of SEQ ID NOs: 723, 727, 731, 735, 739, 743, 747, 751, 755, 759, 763, 767, 771, 775, 779, 783, 787, 791, 795, 799, 803, 807, 811, 815, 819, 823, 827, 831, 835, 839, 843, 847, 851, 855, 859, 863, 867, 871, 875, 879, 883, 887, 891, 895, 899, 903, 907, 911, 915, 919, 923, 927, 931, 935, 939, 943, 947, 951, 955, 959, 1286, 1296, 1306, 1316, 1326, 1336, 1346, and 1356 and a heavy chain variable region comprising a sequence selected from the group consisting of SEQ ID NOs: 724, 728, 732, 736, 740, 744, 748, 752, 756, 760, 764, 768, 772, 776, 780, 784, 788, 792, 796, 800, 804, 808, 812, 816, 820, 824, 828, 832, 836, 840, 844, 848, 852, 856, 860, 864, 868, 872, 876, 880, 884, 888, 892, 896, 900, 904, 908, 912, 916, 920, 924, 928, 932, 936, 940, 944, 948, 952, 956, 960, 1287, 1297, 1307, 1317, 1327, 1337, 1347, and 1357.

In one embodiment the antibody or fragment thereof comprises a combination of light chain variable region and a heavy chain variable region selected from the group consisting of a light chain variable region comprising SEQ ID NO: 723 and a heavy chain variable region comprising SEQ ID NO: 724; a light chain variable region comprising SEQ ID NO: 727 and a heavy chain variable region comprising SEQ ID NO: 728; a light chain variable region comprising SEQ ID NO: 731 and a heavy chain variable region comprising SEQ ID NO: 732; a light chain variable region comprising SEQ ID NO: 735 and a heavy chain variable region comprising SEQ ID NO: 736; a light chain variable region comprising SEQ ID NO: 739 and a heavy chain variable region comprising SEQ ID NO: 740; a light chain variable region comprising SEQ ID NO: 743 and a heavy chain variable region comprising SEQ ID NO: 744; a light chain variable region comprising SEQ ID NO: 747 and a heavy chain variable region comprising SEQ ID NO: 748; a light chain variable region comprising SEQ ID NO: 751 and a heavy chain variable region comprising SEQ ID NO: 752; a light chain variable region comprising SEQ ID NO: 755 and a heavy chain variable region comprising SEQ ID NO: 756; a light chain variable region comprising SEQ ID NO: 759 and a heavy chain variable region comprising SEQ ID NO: 760; a light chain variable region comprising SEQ ID NO: 763 and a heavy chain variable region comprising SEQ ID NO: 764; a light chain variable region comprising SEQ ID NO: 767 and a heavy chain variable region comprising SEQ ID NO: 768; a light chain variable region comprising SEQ ID NO: 771 and a heavy chain variable region comprising SEQ ID NO: 772; a light chain variable region comprising SEQ ID NO: 775 and a heavy chain variable region comprising SEQ ID NO: 776; a light chain variable region comprising SEQ ID NO: 779 and a heavy chain variable region comprising SEQ ID NO: 780; a light chain variable region comprising SEQ ID NO: 783 and a heavy chain variable region comprising SEQ ID NO: 784; a light chain variable region comprising SEQ ID NO: 787 and a heavy chain variable region comprising SEQ ID NO: 788; a light chain variable region comprising SEQ ID NO: 791 and a heavy chain variable region comprising SEQ ID NO: 792; a light chain variable region comprising SEQ ID NO: 795 and a heavy chain variable region comprising SEQ ID NO: 796; a light chain variable region comprising SEQ ID NO: 799 and a heavy chain variable region comprising SEQ ID NO: 800; a light chain variable region comprising SEQ ID NO: 803 and a heavy chain variable region comprising SEQ ID NO: 804; a light chain variable region comprising SEQ ID NO: 807 and a heavy chain variable region comprising SEQ ID NO: 808; a light chain variable region comprising SEQ ID NO: 811 and a heavy chain variable region comprising SEQ ID NO: 812; a light chain variable region comprising SEQ ID NO: 815 and a heavy chain variable region comprising SEQ ID NO: 816; a light chain variable region comprising SEQ ID NO: 819 and a heavy chain variable region comprising SEQ ID NO: 820; a light chain variable region comprising SEQ ID NO: 823 and a heavy chain variable region comprising SEQ ID NO: 824; a light chain variable region comprising SEQ ID NO: 827 and a heavy chain variable region comprising SEQ ID NO: 828; a light chain variable region comprising SEQ ID NO: 831 and a heavy chain variable region comprising SEQ ID NO: 832; a light chain variable region comprising SEQ ID NO: 835 and a heavy chain variable region comprising SEQ ID NO: 836; a light chain variable region comprising SEQ ID NO: 839 and a heavy chain variable region comprising SEQ ID NO: 840; a light chain variable region comprising SEQ ID NO: 843 and a heavy chain variable region comprising SEQ ID NO: 844; a light chain variable region comprising SEQ ID NO: 847 and a heavy chain variable region comprising SEQ ID NO: 848; a light chain variable region comprising SEQ ID NO: 851 and a heavy chain variable region comprising SEQ ID NO: 852; a light chain variable region comprising SEQ ID NO: 855 and a heavy chain variable region comprising SEQ ID NO: 856; a light chain variable region comprising SEQ ID NO: 859 and a heavy chain variable region comprising SEQ ID NO: 860; a light chain variable region comprising SEQ ID NO: 863 and a heavy chain variable region comprising SEQ ID NO: 864; a light chain variable region comprising SEQ ID NO: 867 and a heavy chain variable region comprising SEQ ID NO: 868; a light chain variable region comprising SEQ ID NO: 871 and a heavy chain variable region comprising SEQ ID NO: 872; a light chain variable region comprising SEQ ID NO: 875 and a heavy chain variable region comprising SEQ ID NO: 876; a light chain variable region comprising SEQ ID NO: 879 and a heavy chain variable region comprising SEQ ID NO: 880; a light chain variable region comprising SEQ ID NO: 883 and a heavy chain variable region comprising SEQ ID NO: 884; a light chain variable region comprising SEQ ID NO: 887 and a heavy chain variable region comprising SEQ ID NO: 888; a light chain variable region comprising SEQ ID NO: 891 and a heavy chain variable region comprising SEQ ID NO: 892; a light chain variable region comprising SEQ ID NO: 895 and a heavy chain variable region comprising SEQ ID NO: 896; a light chain variable region comprising SEQ ID NO: 899 and a heavy chain variable region comprising SEQ ID NO: 900; a light chain variable region comprising SEQ ID NO: 903 and a heavy chain variable region comprising SEQ ID NO: 904; a light chain variable region comprising SEQ ID NO: 907 and a heavy chain variable region comprising SEQ ID NO: 908; a light chain variable region comprising SEQ ID NO: 911 and a heavy chain variable region comprising SEQ ID NO: 912; a light chain variable region comprising SEQ ID NO: 915 and a heavy chain variable region comprising SEQ ID NO: 916; a light chain variable region comprising SEQ ID NO: 919 and a heavy chain variable region comprising SEQ ID NO: 920; a light chain variable region comprising SEQ ID NO: 923 and a heavy chain variable region comprising SEQ ID NO: 924; a light chain variable region comprising SEQ ID NO: 927 and a heavy chain variable region comprising SEQ ID NO: 928; a light chain variable region comprising SEQ ID NO: 931 and a heavy chain variable region comprising SEQ ID NO: 932; a light chain variable region comprising SEQ ID NO: 935 and a heavy chain variable region comprising SEQ ID NO: 936; a light chain variable region comprising SEQ ID NO: 939 and a heavy chain variable region comprising SEQ ID NO: 940; a light chain variable region comprising SEQ ID NO: 943 and a heavy chain variable region comprising SEQ ID NO: 944; a light chain variable region comprising SEQ ID NO: 947 and a heavy chain variable region comprising SEQ ID NO: 948; a light chain variable region comprising SEQ ID NO: 951 and a heavy chain variable region comprising SEQ ID NO: 952; a light chain variable region comprising SEQ ID NO: 955 and a heavy chain variable region comprising SEQ ID NO: 956; a light chain variable region comprising SEQ ID NO: 959 and a heavy chain variable region comprising SEQ ID NO: 960; a light chain variable region comprising SEQ ID NO: 1286 and a heavy chain variable region comprising SEQ ID NO: 1287; a light chain variable region comprising SEQ ID NO: 1296 and a heavy chain variable region comprising SEQ ID NO: 1297; a light chain variable region comprising SEQ ID NO: 1306 and a heavy chain variable region comprising SEQ ID NO: 1307; a light chain variable region comprising SEQ ID NO: 1316 and a heavy chain variable region comprising SEQ ID NO: 1317; a light chain variable region comprising SEQ ID NO: 1326 and a heavy chain variable region comprising SEQ ID NO: 1327; a light chain variable region comprising SEQ ID NO: 1336 and a heavy chain variable region comprising SEQ ID NO: 1337; a light chain variable region comprising SEQ ID NO: 1346 and a heavy chain variable region comprising SEQ ID NO: 1347; and a light chain variable region comprising SEQ ID NO: 1356 and a heavy chain variable region comprising SEQ ID NO: 1357.

In one embodiment the antibody or fragment thereof comprises a light chain variable region encoded by a polynucleotide sequence selected from the group consisting of SEQ ID NOs: 721, 725, 729, 733, 737, 741, 745, 749, 753, 757, 761, 765, 769, 773, 777, 781, 785, 789, 793, 797, 801, 805, 809, 813, 817, 821, 825, 829, 833, 837, 841, 845, 849, 853, 857, 861, 865, 869, 873, 877, 881, 885, 889, 893, 897, 901, 905, 909, 913, 917, 921, 925, 929, 933, 937, 941, 945, 949, 953, 955, 1377, 1379, 1381, 1383, 1385, 1387, 1389, and 1391. In one embodiment the antibody or fragment thereof comprises a heavy chain variable region encoded by a polynucleotide selected from the group consisting of SEQ ID NOs: 722, 726, 730, 734, 738, 742, 746, 750, 754, 758, 762, 766, 770, 774, 778, 782, 786, 790, 794, 798, 802, 806, 810, 814, 818, 822, 826, 830, 834, 838, 842, 846, 850, 854, 858, 862, 866, 870, 874, 878, 882, 886, 890, 894, 898, 902, 906, 910, 914, 918, 922, 926, 930, 934, 938, 942, 946, 950, 954, 958, 1378, 1380, 1382, 1384, 1386, 1388, 1390, and 1392. In one embodiment the antibody or fragment thereof comprises a light chain variable region encoded by a polynucleotide sequence selected from the group consisting of SEQ ID NOs: 721, 725, 729, 733, 737, 741, 745, 749, 753, 757, 761, 765, 769, 773, 777, 781, 785, 789, 793, 797, 801, 805, 809, 813, 817, 821, 825, 829, 833, 837, 841, 845, 849, 853, 857, 861, 865, 869, 873, 877, 881, 885, 889, 893, 897, 901, 905, 909, 913, 917, 921, 925, 929, 933, 937, 941, 945, 949, 953, 955, 1377, 1379, 1381, 1383, 1385, 1387, 1389, and 1391 and a heavy chain variable region encoded by a polynucleotide sequence selected from the group consisting of SEQ ID NOs: 722, 726, 730, 734, 738, 742, 746, 750, 754, 758, 762, 766, 770, 774, 778, 782, 786, 790, 794, 798, 802, 806, 810, 814, 818, 822, 826, 830, 834, 838, 842, 846, 850, 854, 858, 862, 866, 870, 874, 878, 882, 886, 890, 894, 898, 902, 906, 910, 914, 918, 922, 926, 930, 934, 938, 942, 946, 950, 954, 958, 1378, 1380, 1382, 1384, 1386, 1388, 1390, and 1392. In one embodiment the antibody or fragment thereof comprises a combination of light chain variable region and a heavy chain variable region selected from the group consisting of a light chain variable region encoded by a light chain variable region encoded by a polynucleotide sequence comprising SEQ ID NO: 721 and a heavy chain variable region encoded by a polynucleotide sequence comprising SEQ ID NO: 722; a light chain variable region encoded by a polynucleotide sequence comprising SEQ ID NO: 725 and a heavy chain variable region encoded by a polynucleotide sequence comprising SEQ ID NO: 726; a light chain variable region encoded by a polynucleotide sequence comprising SEQ ID NO: 729 and a heavy chain variable region encoded by a polynucleotide sequence comprising SEQ ID NO: 730; a light chain variable region encoded by a polynucleotide sequence comprising SEQ ID NO: 733 and a heavy chain variable region encoded by a polynucleotide sequence comprising SEQ ID NO: 734; a light chain variable region encoded by a polynucleotide sequence comprising SEQ ID NO: 737 and a heavy chain variable region encoded by a polynucleotide sequence comprising SEQ ID NO: 738; a light chain variable region encoded by a polynucleotide sequence comprising SEQ ID NO: 741 and a heavy chain variable region encoded by a polynucleotide sequence comprising SEQ ID NO: 742; a light chain variable region encoded by a polynucleotide sequence comprising SEQ ID NO: 745 and a heavy chain variable region encoded by a polynucleotide sequence comprising SEQ ID NO: 746; a light chain variable region encoded by a polynucleotide sequence comprising SEQ ID NO: 749 and a heavy chain variable region encoded by a polynucleotide sequence comprising SEQ ID NO: 750; a light chain variable region encoded by a polynucleotide sequence comprising SEQ ID NO: 753 and a heavy chain variable region encoded by a polynucleotide sequence comprising SEQ ID NO: 754; a light chain variable region encoded by a polynucleotide sequence comprising SEQ ID NO: 757 and a heavy chain variable region encoded by a polynucleotide sequence comprising SEQ ID NO: 758; a light chain variable region encoded by a polynucleotide sequence comprising SEQ ID NO: 761 and a heavy chain variable region encoded by a polynucleotide sequence comprising SEQ ID NO: 762; a light chain variable region encoded by a polynucleotide sequence comprising SEQ ID NO: 765 and a heavy chain variable region encoded by a polynucleotide sequence comprising SEQ ID NO: 766; a light chain variable region encoded by a polynucleotide sequence comprising SEQ ID NO: 769 and a heavy chain variable region encoded by a polynucleotide sequence comprising SEQ ID NO: 770; a light chain variable region encoded by a polynucleotide sequence comprising SEQ ID NO: 773 and a heavy chain variable region encoded by a polynucleotide sequence comprising SEQ ID NO: 774; a light chain variable region encoded by a polynucleotide sequence comprising SEQ ID NO: 777 and a heavy chain variable region encoded by a polynucleotide sequence comprising SEQ ID NO: 778; a light chain variable region encoded by a polynucleotide sequence comprising SEQ ID NO: 781 and a heavy chain variable region encoded by a polynucleotide sequence comprising SEQ ID NO: 782; a light chain variable region encoded by a polynucleotide sequence comprising SEQ ID NO: 785 and a heavy chain variable region encoded by a polynucleotide sequence comprising SEQ ID NO: 786; a light chain variable region encoded by a polynucleotide sequence comprising SEQ ID NO: 789 and a heavy chain variable region encoded by a polynucleotide sequence comprising SEQ ID NO: 790; a light chain variable region encoded by a polynucleotide sequence comprising SEQ ID NO: 793 and a heavy chain variable region encoded by a polynucleotide sequence comprising SEQ ID NO: 794; a light chain variable region encoded by a polynucleotide sequence comprising SEQ ID NO: 797 and a heavy chain variable region encoded by a polynucleotide sequence comprising SEQ ID NO: 798; a light chain variable region encoded by a polynucleotide sequence comprising SEQ ID NO: 801 and a heavy chain variable region encoded by a polynucleotide sequence comprising SEQ ID NO: 802; a light chain variable region encoded by a polynucleotide sequence comprising SEQ ID NO: 805 and a heavy chain variable region encoded by a polynucleotide sequence comprising SEQ ID NO: 806; a light chain variable region encoded by a polynucleotide sequence comprising SEQ ID NO: 809 and a heavy chain variable region encoded by a polynucleotide sequence comprising SEQ ID NO: 810; a light chain variable region encoded by a polynucleotide sequence comprising SEQ ID NO: 813 and a heavy chain variable region encoded by a polynucleotide sequence comprising SEQ ID NO: 814; a light chain variable region encoded by a polynucleotide sequence comprising SEQ ID NO: 817 and a heavy chain variable region encoded by a polynucleotide sequence comprising SEQ ID NO: 818; a light chain variable region encoded by a polynucleotide sequence comprising SEQ ID NO: 821 and a heavy chain variable region encoded by a polynucleotide sequence comprising SEQ ID NO: 822; a light chain variable region encoded by a polynucleotide sequence comprising SEQ ID NO: 825 and a heavy chain variable region encoded by a polynucleotide sequence comprising SEQ ID NO: 826; a light chain variable region encoded by a polynucleotide sequence comprising SEQ ID NO: 829 and a heavy chain variable region encoded by a polynucleotide sequence comprising SEQ ID NO: 830; a light chain variable region encoded by a polynucleotide sequence comprising SEQ ID NO: 833 and a heavy chain variable region encoded by a polynucleotide sequence comprising SEQ ID NO: 834; a light chain variable region encoded by a polynucleotide sequence comprising SEQ ID NO: 837 and a heavy chain variable region encoded by a polynucleotide sequence comprising SEQ ID NO: 838; a light chain variable region encoded by a polynucleotide sequence comprising SEQ ID NO: 841 and a heavy chain variable region encoded by a polynucleotide sequence comprising SEQ ID NO: 842; a light chain variable region encoded by a polynucleotide sequence comprising SEQ ID NO: 845 and a heavy chain variable region encoded by a polynucleotide sequence comprising SEQ ID NO: 846; a light chain variable region encoded by a polynucleotide sequence comprising SEQ ID NO: 849 and a heavy chain variable region encoded by a polynucleotide sequence comprising SEQ ID NO: 850; a light chain variable region encoded by a polynucleotide sequence comprising SEQ ID NO: 853 and a heavy chain variable region encoded by a polynucleotide sequence comprising SEQ ID NO: 854; a light chain variable region encoded by a polynucleotide sequence comprising SEQ ID NO: 857 and a heavy chain variable region encoded by a polynucleotide sequence comprising SEQ ID NO: 858; a light chain variable region encoded by a polynucleotide sequence comprising SEQ ID NO: 861 and a heavy chain variable region encoded by a polynucleotide sequence comprising SEQ ID NO: 862; a light chain variable region encoded by a polynucleotide sequence comprising SEQ ID NO: 865 and a heavy chain variable region encoded by a polynucleotide sequence comprising SEQ ID NO: 866; a light chain variable region encoded by a polynucleotide sequence comprising SEQ ID NO: 869 and a heavy chain variable region encoded by a polynucleotide sequence comprising SEQ ID NO: 870; a light chain variable region encoded by a polynucleotide sequence comprising SEQ ID NO: 873 and a heavy chain variable region encoded by a polynucleotide sequence comprising SEQ ID NO: 874; a light chain variable region encoded by a polynucleotide sequence comprising SEQ ID NO: 877 and a heavy chain variable region encoded by a polynucleotide sequence comprising SEQ ID NO: 878; a light chain variable region encoded by a polynucleotide sequence comprising SEQ ID NO: 881 and a heavy chain variable region encoded by a polynucleotide sequence comprising SEQ ID NO: 882; a light chain variable region encoded by a polynucleotide sequence comprising SEQ ID NO: 885 and a heavy chain variable region encoded by a polynucleotide sequence comprising SEQ ID NO: 886; a light chain variable region encoded by a polynucleotide sequence comprising SEQ ID NO: 889 and a heavy chain variable region encoded by a polynucleotide sequence comprising SEQ ID NO: 890; a light chain variable region encoded by a polynucleotide sequence comprising SEQ ID NO: 893 and a heavy chain variable region encoded by a polynucleotide sequence comprising SEQ ID NO: 894; a light chain variable region encoded by a polynucleotide sequence comprising SEQ ID NO: 897 and a heavy chain variable region encoded by a polynucleotide sequence comprising SEQ ID NO: 898; a light chain variable region encoded by a polynucleotide sequence comprising SEQ ID NO: 901 and a heavy chain variable region encoded by a polynucleotide sequence comprising SEQ ID NO: 902; a light chain variable region encoded by a polynucleotide sequence comprising SEQ ID NO: 905 and a heavy chain variable region encoded by a polynucleotide sequence comprising SEQ ID NO: 906; a light chain variable region encoded by a polynucleotide sequence comprising SEQ ID NO: 909 and a heavy chain variable region encoded by a polynucleotide sequence comprising SEQ ID NO: 910; a light chain variable region encoded by a polynucleotide sequence comprising SEQ ID NO: 913 and a heavy chain variable region encoded by a polynucleotide sequence comprising SEQ ID NO: 914; a light chain variable region encoded by a polynucleotide sequence comprising SEQ ID NO: 917 and a heavy chain variable region encoded by a polynucleotide sequence comprising SEQ ID NO: 918; a light chain variable region encoded by a polynucleotide sequence comprising SEQ ID NO: 921 and a heavy chain variable region encoded by a polynucleotide sequence comprising SEQ ID NO: 922; a light chain variable region encoded by a polynucleotide sequence comprising SEQ ID NO: 925 and a heavy chain variable region encoded by a polynucleotide sequence comprising SEQ ID NO: 926; a light chain variable region encoded by a polynucleotide sequence comprising SEQ ID NO: 929 and a heavy chain variable region encoded by a polynucleotide sequence comprising SEQ ID NO: 930; a light chain variable region encoded by a polynucleotide sequence comprising SEQ ID NO: 933 and a heavy chain variable region encoded by a polynucleotide sequence comprising SEQ ID NO: 934; a light chain variable region encoded by a polynucleotide sequence comprising SEQ ID NO: 937 and a heavy chain variable region encoded by a polynucleotide sequence comprising SEQ ID NO: 938; a light chain variable region encoded by a polynucleotide sequence comprising SEQ ID NO: 941 and a heavy chain variable region encoded by a polynucleotide sequence comprising SEQ ID NO: 942; a light chain variable region encoded by a polynucleotide sequence comprising SEQ ID NO: 945 and a heavy chain variable region encoded by a polynucleotide sequence comprising SEQ ID NO: 946; a light chain variable region encoded by a polynucleotide sequence comprising SEQ ID NO: 949 and a heavy chain variable region encoded by a polynucleotide sequence comprising SEQ ID NO: 950; a light chain variable region encoded by a polynucleotide sequence comprising SEQ ID NO: 953 and a heavy chain variable region encoded by a polynucleotide sequence comprising SEQ ID NO: 954; a light chain variable region encoded by a polynucleotide sequence comprising SEQ ID NO: 957 and a heavy chain variable region encoded by a polynucleotide sequence comprising SEQ ID NO: 958; a light chain variable region encoded by a polynucleotide sequence comprising SEQ ID NO: 1377 and a heavy chain variable region encoded by a polynucleotide sequence comprising SEQ ID NO: 1378; a light chain variable region encoded by a polynucleotide sequence comprising SEQ ID NO: 1379 and a heavy chain variable region encoded by a polynucleotide sequence comprising SEQ ID NO: 1380; a light chain variable region encoded by a polynucleotide sequence comprising SEQ ID NO: 1381 and a heavy chain variable region encoded by a polynucleotide sequence comprising SEQ ID NO: 1382; a light chain variable region encoded by a polynucleotide sequence comprising SEQ ID NO: 1383 and a heavy chain variable region encoded by a polynucleotide sequence comprising SEQ ID NO: 1384; a light chain variable region encoded by a polynucleotide sequence comprising SEQ ID NO: 1385 and a heavy chain variable region encoded by a polynucleotide sequence comprising SEQ ID NO: 1386; a light chain variable region encoded by a polynucleotide sequence comprising SEQ ID NO: 1387 and a heavy chain variable region encoded by a polynucleotide sequence comprising SEQ ID NO: 1388; a light chain variable region encoded by a polynucleotide sequence comprising SEQ ID NO: 1389 and a heavy chain variable region encoded by a polynucleotide sequence comprising SEQ ID NO: 1390; and a light chain variable region encoded by a polynucleotide sequence comprising SEQ ID NO: 1391 and a heavy chain variable region encoded by a polynucleotide sequence comprising SEQ ID NO: 1392.

Some antigen binding proteins comprise a variable light domain and a variable heavy domain as listed in one of the rows for one of the antibodies listed in TABLE 3. In some instances, the antigen binding protein comprises two identical variable light domains and two identical variable heavy domains from one of the antibodies listed in TABLE 3. Some antigen binding proteins that are provided comprise a variable light domain and a variable heavy domain as listed in one of the rows for one of the antibodies listed in TABLE 3, except that one or both of the domains differs from the sequence specified in the table at only 1, 2, 3, 4, 5, 6, 7, 8, 9, 10, 11, 12, 13, 14 or 15 amino acid residues, wherein each such sequence difference is independently either a single amino acid deletion, insertion or substitution, with the deletions, insertions and/or substitutions resulting in no more than 1, 2, 3, 4, 5, 6, 7, 8, 9, 10, 11, 12, 13, 14 or 15 amino acid changes relative to the variable domain sequences specified in TABLE 3. In one embodiment, the antigen binding protein comprises a variable region sequence from Table 3, but with the N-terminal methionine deleted. Other antigen binding proteins also comprise a variable light domain and a variable heavy domain as listed in one of the rows for one of the antibodies listed in TABLE 3, except that one or both of the domains differs from the sequence specified in the table in that the heavy chain variable domain and/or light chain variable domain comprises or consists of a sequence of amino acids that has at least 70%, 75%, 80%, 85%, 90%, 95%, 96%, 97%, 98%, or 99% sequence identity to the amino acid sequences of the heavy chain variable domain or light chain variable domain sequences as specified in TABLE 3.

In another aspect, the antigen binding protein consists just of a variable light or variable heavy domain from an antibody listed in TABLE 3. In still another aspect, the antigen binding protein comprises two or more of the same variable heavy domains or two or more of the same variable light domains from those listed in TABLE 3. Such domain antibodies can be fused together or joined via a linker as described in greater detail below. The domain antibodies can also be fused or linked to one or more molecules to extend the half-life (e.g., PEG or albumin).

In certain embodiments it is desired that the antigen binding protein is an antibody with reduced viscosity. Such of antigen binding proteins can be produced by modifying sequences in framework regions and/or the Fc domain that are shown to be associated with high viscosity.

Such reduced-viscosity antigen binding proteins included antibodies wherein:

- the VH1|1-18 germline subfamily sequence comprises one or more substitutions selected from 82R, 94S, and 95R;
- the VH3β-33 germline subfamily sequence comprises one or more of substitutions 1E, 17G, and 85A;
- the VK3|L16 germline subfamily sequence comprises one or more substitutions selected from 4L, 13L, 76D, 95R, 97E, and 98P;
- the VK3|L6 germline subfamily sequence comprises one or more substitutions selected from 76D and 95R;
- the Fc domain sequence comprises one or more substitutions selected from 253A, 440K, and 439E; and
- the Fc domain C-terminus comprises a sequence selected from KP, KKP, KKKP (SEQ ID NO. 1398), and E.

All of the foregoing preferred viscosity-reducing amino acid substitutions in variable regions are identified by the Aho numbering system. All viscosity-reducing residues in conserved regions including Fc are identified by the EU numbering system.

Other antigen binding proteins that are provided are variants of antibodies formed by combination of the heavy and light chains shown in TABLE 3 and comprise light and/or heavy chains that each have at least 70%, 75%, 80%, 85%, 90%, 95%, 96%, 97%, 98% or 99% identity to the amino acid sequences of these chains. In some instances, such antibodies include at least one heavy chain and one light chain, whereas in other instances the variant forms contain two identical light chains and two identical heavy chains.

The various combinations of heavy chain variable regions may be combined with any of the various combinations of light chain variable regions.

In a further embodiment, the isolated antigen binding protein provided herein is a human antibody comprising a sequence as set forth in TABLE 3 and is of the $IgG_1$-, $IgG_2$-$IgG_3$- or $IgG_4$-type.

The antigen binding proteins disclosed herein are polypeptides into which one or more CDRs are grafted, inserted and/or joined. An antigen binding protein can have 1, 2, 3, 4, 5 or 6 CDRs. An antigen binding protein thus can have, for example, one heavy chain CDR1 ("CDRH1"), and/or one heavy chain CDR2 ("CDRH2"), and/or one heavy chain CDR3 ("CDRH3"), and/or one light chain CDR1 ("CDRL1"), and/or one light chain CDR2 ("CDRL2"), and/or one light chain CDR3 ("CDRL3"). Some antigen binding proteins include both a CDRH3 and a CDRL3. Specific light and heavy chain CDRs are identified in TABLEs 4A and 4B, respectively.

Complementarity determining regions (CDRs) and framework regions (FR) of a given antibody may be identified using the system described by Kabat et al. in Sequences of Proteins of Immunological Interest, 5th Ed., US Dept. of Health and Human Services, PHS, NIH, NIH Publication no. 91-3242, 1991. Certain antibodies that are disclosed herein comprise one or more amino acid sequences that are identical or have substantial sequence identity to the amino acid sequences of one or more of the CDRs presented in TABLES 4A and 4B. These CDRs use the system described by Kabat et al. as noted above.

The structure and properties of CDRs within a naturally occurring antibody has been described, supra. Briefly, in a traditional antibody, the CDRs are embedded within a framework in the heavy and light chain variable region where they constitute the regions responsible for antigen binding and recognition. A variable region comprises at least three heavy or light chain CDRs, see, supra (Kabat et al., 1991, *Sequences of Proteins of Immunological Interest*, Public Health Service N.I.H., Bethesda, MD; see also Chothia and Lesk, 1987, *J. Mol. Biol.* 196:901-917; Chothia et al., 1989, *Nature* 342: 877-883), within a framework region (designated framework regions 1-4, FR1, FR2, FR3, and FR4, by Kabat et al., 1991, supra; see also Chothia and Lesk, 1987, supra). The CDRs provided herein, however, may not only be used to define the antigen binding domain of a traditional antibody structure, but may be embedded in a variety of other polypeptide structures, as described herein.

In one embodiment the antibody or fragment thereof comprises a CDRL1, a CDRL2, a CDRL3, a CDRH1, a CDRH2, and a CDRH3. In one embodiment the antibody or fragment thereof comprises a CDRL1 comprising a sequence selected from the group consisting of SEQ ID NOs: 4, 10, 16, 22, 28, 34, 40, 46, 52, 58, 64, 70, 76, 82, 88, 94, 100, 106, 112, 118, 124, 130, 136, 142, 148, 154, 160, 166, 172, 178, 184, 190, 196, 202, 208, 214, 220, 226, 232, 238, 244, 250, 256, 262, 268, 274, 280, 286, 292, 298, 304, 310, 316, 322, 328, 334, 340, 346, 352, 358, 1290, 1300, 1310, 1320, 1330, 1340, and 1350. In one embodiment the antibody or fragment thereof comprises a CDRL2 comprising a sequence selected from the group consisting of SEQ ID NOs: 5, 11, 17, 23, 29, 35, 41, 47, 53, 59, 65, 71, 77, 83, 89, 95, 101, 107, 113, 119, 125, 131, 137, 143, 149, 155, 161, 167, 173, 179, 185, 191, 197, 203, 209, 215, 221, 227, 233, 239, 245, 251, 257, 263, 269, 275, 281, 287, 293, 299, 305, 311, 317, 323, 329, 335, 341, 347, 353, 359, 1291, 1301, 1311, 1321, 1331, 1341, and 1351. In one embodiment the antibody or fragment thereof comprises a CDRL3 comprising a sequence selected from the group consisting of SEQ ID NOs: 6, 12, 18, 24, 30, 36, 42, 48, 54, 60, 66, 72, 78, 84, 90, 96, 102, 108, 114, 120, 126, 132, 138, 144, 150, 156, 162, 168, 174, 180, 186, 192, 198, 204, 210, 216, 222, 228, 234, 240, 246, 252, 258, 264, 270, 276, 282, 288, 294, 300, 306, 312, 318, 324, 330, 336, 342, 348, 354, 360, 1292, 1302, 1312, 1322, 1332, 1342, and 1352. In one embodiment the antibody or fragment thereof comprises a CDRH1 comprising a sequence selected from the group consisting of SEQ ID NOs: 364, 370, 376, 382, 388, 394, 400, 406, 412, 418, 424, 430, 436, 442, 448, 454, 460, 466, 472, 478, 484, 490, 496, 502, 508, 514, 520, 526, 532, 538, 544, 550, 556, 562, 568, 574, 580, 586, 592, 598, 604, 610, 616, 622, 628, 634, 640, 646, 652, 658, 664, 670, 676, 682, 688, 694, 700, 706, 712, 718, 1293, 1303, 1313, 1323, 1333, 1343, and 1353. In one embodiment the antibody or fragment thereof comprises a CDRH2 comprising a sequence selected from the group consisting of SEQ ID NOs: 365, 371, 377, 383, 389, 395, 401, 407, 413, 419, 425, 431, 437, 443, 449, 455, 461, 467, 473, 479, 485, 491, 497, 503, 509, 515, 521, 527, 533, 539, 545, 551, 557, 563, 569, 575, 581, 587, 593, 599, 605, 611, 617, 623, 629, 635, 641, 647, 653, 659, 665, 671, 677, 683, 689, 695, 701, 707, 713, 719, 1294, 1304, 1314, 1324, 1334, 1344, and 1354. In one embodiment the antibody or fragment thereof comprises a CDRH3 comprising a sequence selected from the group consisting of SEQ ID NOs: 366, 372, 378, 384, 390, 396, 402, 408, 414, 420, 426, 432, 438, 444, 450, 456, 462, 468, 474, 480, 486, 492, 498, 504, 510, 516, 522, 528, 534, 540, 546, 552, 558, 564, 570, 576, 582, 588, 594, 600, 606, 612, 618, 624, 630, 636, 642, 648, 654, 660, 666, 672, 678, 684, 690, 696, 702, 708, 714, 720, 1295, 1305, 1315, 1325, 1335, 1345, and 1355. In one embodiment the antibody or fragment thereof comprises a CDRL1, a CDRL2, a CDRL3, a CDRH1, a CDRH2, and a CDRH3, wherein each CDRL1, CDRL2, CDRL3, CDRH1, CDRH2, and CDRH3, respectively, comprises a sequence selected from the group consisting of SEQ ID NO: 4, SEQ ID NO: 5, SEQ ID NO: 6, SEQ ID NO: 364, SEQ ID NO: 365, and SEQ ID NO: 366; SEQ ID NO: 10, SEQ ID NO: 11, SEQ ID NO: 12, SEQ ID NO: 370, SEQ ID NO: 371, and SEQ ID NO: 372; SEQ ID NO: 16, SEQ ID NO: 17, SEQ ID NO: 18, SEQ ID NO: 376, SEQ ID NO: 377, and SEQ ID NO: 378; SEQ ID NO: 22, SEQ ID NO: 23, SEQ ID NO: 24, SEQ ID NO: 382, SEQ ID NO: 383, and SEQ ID NO: 384; SEQ ID NO: 28, SEQ ID NO: 29, SEQ ID NO: 30, SEQ ID NO: 388, SEQ ID NO: 389, and SEQ ID NO: 390; SEQ ID NO: 34, SEQ ID NO: 35, SEQ ID NO: 36, SEQ ID NO: 394, SEQ ID NO: 395, and SEQ ID NO: 396; SEQ ID NO: 40, SEQ ID NO: 41, SEQ ID NO: 42, SEQ ID NO: 400, SEQ ID NO: 401, and SEQ ID NO: 402; SEQ ID NO: 46, SEQ ID NO: 47, SEQ ID NO: 48, SEQ ID NO: 406, SEQ ID NO: 407, and SEQ ID NO: 408; SEQ ID NO: 52, SEQ ID NO: 53, SEQ ID NO: 54, SEQ ID NO: 412, SEQ ID NO: 413, and SEQ ID NO: 414; SEQ ID NO: 58, SEQ ID NO: 59, SEQ ID NO: 60, SEQ ID NO: 418, SEQ ID NO: 419, and SEQ ID NO: 420; SEQ ID NO: 64, SEQ ID NO: 65, SEQ ID NO: 66, SEQ ID NO: 424, SEQ ID NO: 425, and SEQ ID NO: 426; SEQ ID NO: 70, SEQ ID NO: 71, SEQ ID NO: 72, SEQ ID NO: 430, SEQ ID NO: 431, and SEQ ID NO: 432; SEQ ID NO: 76, SEQ ID NO: 77, SEQ ID NO: 78, SEQ ID NO: 436, SEQ ID NO: 437, and SEQ ID NO: 438; SEQ ID NO: 82, SEQ ID NO: 83, SEQ ID NO: 84, SEQ ID NO: 442, SEQ ID NO: 443, and SEQ ID NO: 444; SEQ ID NO: 88, SEQ ID NO: 89, SEQ ID NO: 90, SEQ ID NO: 448, SEQ ID NO: 449, and SEQ ID NO: 450; SEQ ID NO: 94, SEQ ID NO: 95, SEQ ID NO: 96, SEQ ID NO: 454, SEQ ID NO: 455, and SEQ ID NO: 456; SEQ ID NO: 100, SEQ ID NO: 101, SEQ ID NO: 102, SEQ ID NO: 460, SEQ ID NO: 461, and SEQ ID NO: 462; SEQ ID NO: 106, SEQ ID NO: 107, SEQ ID NO: 108, SEQ ID NO: 466, SEQ ID NO: 467, and SEQ ID NO: 468; SEQ ID NO: 112, SEQ ID NO: 113, SEQ ID NO: 114, SEQ ID NO: 472, SEQ ID NO: 473, and SEQ ID NO: 474; SEQ ID NO: 118, SEQ ID NO: 119, SEQ ID NO: 120, SEQ ID NO: 478, SEQ ID NO: 479, and SEQ ID NO: 480; SEQ ID NO: 124, SEQ ID NO: 125, SEQ ID NO: 126, SEQ ID NO: 484, SEQ ID NO: 485, and SEQ ID NO: 486; SEQ ID NO: 130, SEQ ID NO: 131, SEQ ID NO: 132, SEQ ID NO: 490, SEQ ID NO: 491, and SEQ ID NO: 492; SEQ ID NO: 136, SEQ ID NO: 137, SEQ ID NO: 138, SEQ ID NO: 496, SEQ ID NO: 497, and SEQ ID NO: 498; SEQ ID NO: 142, SEQ ID NO: 143, SEQ ID NO: 144, SEQ ID NO: 502, SEQ ID NO: 503, and SEQ ID NO: 504; SEQ ID NO: 148, SEQ ID NO: 149, SEQ ID NO: 150, SEQ ID NO: 508, SEQ ID NO: 509, and SEQ ID NO: 510; SEQ ID NO: 154, SEQ ID NO: 155, SEQ ID NO: 156, SEQ ID NO: 514, SEQ ID NO: 515, and SEQ ID NO: 516; SEQ ID NO: 160, SEQ ID NO: 161, SEQ ID NO: 162, SEQ ID NO: 520, SEQ ID NO: 521, and SEQ ID NO: 522; SEQ ID NO: 166, SEQ ID NO: 167, SEQ ID NO: 168, SEQ ID NO: 526, SEQ ID NO: 527, and SEQ ID NO: 528; SEQ ID NO: 172, SEQ ID NO: 173, SEQ ID NO: 174, SEQ ID NO: 532, SEQ ID NO: 533, and SEQ ID NO: 534; SEQ ID NO: 178, SEQ ID NO: 179, SEQ ID NO: 180, SEQ ID NO: 538, SEQ ID NO: 539, and SEQ ID NO: 540; SEQ ID NO: 184, SEQ ID NO: 185, SEQ ID NO: 186, SEQ ID NO: 544, SEQ ID NO: 545, and SEQ ID NO: 546; SEQ ID NO: 190, SEQ ID NO: 191, SEQ ID NO: 192, SEQ ID NO: 550, SEQ ID NO: 551, and SEQ ID NO: 552; SEQ ID NO: 196, SEQ ID NO: 197, SEQ ID NO: 198, SEQ ID NO: 556, SEQ ID NO: 557, and SEQ ID NO: 558; SEQ ID NO: 202, SEQ ID NO: 203, SEQ ID NO: 204, SEQ ID NO: 562, SEQ ID NO: 563, and SEQ ID NO: 564; SEQ ID NO: 208, SEQ ID NO: 209, SEQ ID NO: 210, SEQ ID NO: 568, SEQ ID NO: 569, and SEQ ID NO: 570; SEQ ID NO: 214, SEQ ID NO: 215, SEQ ID NO: 216, SEQ ID NO: 574, SEQ ID NO: 575, and SEQ ID NO: 576; SEQ ID NO: 220, SEQ ID NO: 221, SEQ ID NO: 222, SEQ ID NO: 580, SEQ ID NO: 581, and SEQ ID NO: 582; SEQ ID NO: 226, SEQ ID NO: 227, SEQ ID NO: 228, SEQ ID NO: 586, SEQ ID NO: 587, and SEQ ID NO: 588; SEQ ID NO: 232, SEQ ID NO: 233, SEQ ID NO: 234, SEQ ID NO: 592, SEQ ID NO: 593, and SEQ ID NO: 594; SEQ ID NO: 238, SEQ ID NO: 239, SEQ ID NO: 240, SEQ ID NO: 598, SEQ ID NO: 599, and SEQ ID NO: 600; SEQ ID NO: 244, SEQ ID NO: 245, SEQ ID NO: 246, SEQ ID NO: 604, SEQ ID NO: 605, and SEQ ID NO: 606; SEQ ID NO: 250, SEQ ID NO: 251, SEQ ID NO: 252, SEQ ID NO: 610, SEQ ID NO: 611, and SEQ ID NO: 612; SEQ ID NO: 256, SEQ ID NO: 257, SEQ ID NO: 258, SEQ ID NO: 616, SEQ ID NO: 617, and SEQ ID NO: 618; SEQ ID NO: 262, SEQ ID NO: 263, SEQ ID NO: 264, SEQ ID NO: 622, SEQ ID NO: 623, and SEQ ID NO: 624; SEQ ID NO: 268, SEQ ID NO: 269, SEQ ID NO: 270, SEQ ID NO: 628, SEQ ID NO: 629, and SEQ ID NO: 630; SEQ ID NO: 274, SEQ ID NO: 275, SEQ ID NO: 276, SEQ ID NO: 634, SEQ ID NO: 635, and SEQ ID NO: 636; SEQ ID NO: 280, SEQ ID NO: 281, SEQ ID NO: 282, SEQ ID NO: 640, SEQ ID NO: 641, and SEQ ID NO: 642; SEQ ID NO: 286, SEQ ID NO: 287, SEQ ID NO: 288, SEQ ID NO: 646, SEQ ID NO: 647, and SEQ ID NO: 648; SEQ ID NO: 292, SEQ ID NO: 293, SEQ ID NO: 294, SEQ ID NO: 652, SEQ ID NO: 653, and SEQ ID NO: 654; SEQ ID NO: 298, SEQ ID NO: 299, SEQ ID NO: 300, SEQ ID NO: 658, SEQ ID NO: 659, and SEQ ID NO: 660; SEQ ID NO: 304, SEQ ID NO: 305, SEQ ID NO: 306, SEQ ID NO: 664, SEQ ID NO: 665, and SEQ ID NO: 666; SEQ ID NO: 310, SEQ ID NO: 311, SEQ ID NO: 312, SEQ ID NO: 670, SEQ ID NO: 671, and SEQ ID NO: 672; SEQ ID NO: 316, SEQ ID NO: 317, SEQ ID NO: 318, SEQ ID NO: 676, SEQ ID NO: 677, and SEQ ID NO: 678; SEQ ID NO: 322, SEQ ID NO: 323, SEQ ID NO: 324, SEQ ID NO: 682, SEQ ID NO: 683, and SEQ ID NO: 684; SEQ ID NO: 328, SEQ ID NO: 329, SEQ ID NO: 330, SEQ ID NO: 688, SEQ ID NO: 689, and SEQ ID NO: 690; SEQ ID NO: 334, SEQ ID NO: 335, SEQ ID NO: 336, SEQ ID NO: 694, SEQ ID NO: 695, and SEQ ID NO: 696; SEQ ID NO: 340, SEQ ID NO: 341, SEQ ID NO: 342, SEQ ID NO: 700, SEQ ID NO: 701, and SEQ ID NO: 702; SEQ ID NO: 346, SEQ ID NO: 347, SEQ ID NO: 348, SEQ ID NO: 706, SEQ ID NO: 707, and SEQ ID NO: 708; SEQ ID NO: 352, SEQ ID NO: 353, SEQ ID NO: 354, SEQ ID NO: 712, SEQ ID NO: 713, and SEQ ID NO: 714; SEQ ID NO: 358, SEQ ID NO: 359, SEQ ID NO: 360, SEQ ID NO: 718, SEQ ID NO: 719, and SEQ ID NO: 720; SEQ ID NO: 1290, SEQ ID NO: 1291, SEQ ID NO: 1292, SEQ ID NO: 1293, SEQ ID NO: 1294, and SEQ ID NO: 1295; SEQ ID NO: 1300, SEQ ID NO: 1301, SEQ ID NO: 1302, SEQ ID NO: 1303, SEQ ID NO: 1304, and SEQ ID NO: 1305; SEQ ID NO: 1310, SEQ ID NO: 1311, SEQ ID NO: 1312, SEQ ID NO: 1313, SEQ ID NO: 1314, and SEQ ID NO: 1315; SEQ ID NO: 1320, SEQ ID NO: 1321, SEQ ID NO: 1322, SEQ ID NO: 1323, SEQ ID NO: 1324, and SEQ ID NO: 1325; SEQ ID NO: 1330, SEQ ID NO: 1331, SEQ ID NO: 1332, SEQ ID NO: 1333, SEQ ID NO: 1334, and SEQ ID NO: 1335; SEQ ID NO: 1340, SEQ ID NO: 1341, SEQ ID NO: 1342, SEQ ID NO: 1343, SEQ ID NO: 1344, and SEQ ID NO: 1345; SEQ ID NO: 1350, SEQ ID NO: 1351, SEQ ID NO: 1352, SEQ ID NO: 1353, SEQ ID NO: 1354, and SEQ ID NO: 1355; and SEQ ID NO: 1360, SEQ ID NO: 1361, SEQ ID NO: 1362, SEQ ID NO: 1363, SEQ ID NO: 1364, and SEQ ID NO: 1365.

In another aspect, an antigen binding protein includes 1, 2, 3, 4, 5, or 6 variant forms of the CDRs listed in TABLES 4A and 4B, each having at least 80%, 85%, 90%, 95%, 96%, 97%, 98%, or 99% sequence identity to a CDR sequence listed in TABLES 4A and 4B. Some antigen binding proteins include 1, 2, 3, 4, 5, or 6 of the CDRs listed in TABLES 4A and 4B, each or collectively differing by no more than 1, 2, 3, 4 or 5 amino acids from the CDRs listed in this table.

In various other embodiments, the antigen binding protein is derived from such antibodies. For instance, in one aspect, the antigen binding protein comprises 1, 2, 3, 4, 5 or all 6 of the CDRs listed in one of the rows for any particular antibody listed in TABLES 4A and 4B. In another aspect, an antigen binding protein includes 1, 2, 3, 4, 5, or 6 variant forms of the CDRs listed in one of the rows for an antibody in TABLES 4A and 4B, each CDR having at least 80%, 85%, 90%, 95%, 96%, 97%, 98%, or 99% sequence identity to a CDR sequence listed in TABLES 4A and 4B. Some antigen binding proteins include 1, 2, 3, 4, 5, or 6 of the CDRs listed in one of the rows of TABLES 4A and 4B, each differing by no more than 1, 2, 3, 4 or 5 amino acids from the CDRs listed in these tables. In another aspect, the antigen binding protein comprises all 6 of the CDRS listed in a row of TABLES 4A and 4B and the total number of amino acid changes to the CDRs collectively is no more than 1, 2, 3, 4, or 5 amino acids.

In one embodiment the antibody or fragment thereof comprises a light chain comprising a sequence selected from the group consisting of SEQ ID NOs: 963, 967, 971, 975, 979, 983, 987, 991, 995, 999, 1003, 1007, 1011, 1015, 1019, 1023, 1027, 1031, 1035, 1039, 1043, 1047, 1051, 1055, 1059, 1063, 1067, 1071, 1075, 1079, 1083, 1087, 1091, 1095, 1099, 1103, 1107, 1111, 1115, 1119, 1123, 1127, 1131, 1135, 1139, 1143, 1147, 1151, 1155, 1159, 1163, 1167, 1171, 1175, 1179, 1183, 1187, 1191, 1195, 1199, 1288, 1298, 1308, 1318, 1328, 1338, 1348, and 1358. In one embodiment the antibody or fragment thereof comprises a heavy chain comprising a sequence selected from the group consisting of SEQ ID NOs: 964, 968, 972, 976, 980, 984, 988, 992, 996, 1000, 1004, 1008, 1012, 1016, 1020, 1024, 1028, 1032, 1036, 1040, 1044, 1048, 1052, 1056, 1060, 1064, 1068, 1072, 1076, 1080, 1084, 1088, 1092, 1096, 1100, 1104, 1108, 1112, 1116, 1120, 1124, 1128, 1132, 1136, 1140, 1144, 1148, 1152, 1156, 1160, 1164, 1168, 1172, 1176, 1180, 1184, 1188, 1192, 1196, 1200, 1289, 1299, 1309, 1319, 1329, 1339, 1349, and 1359. In one embodiment the antibody or fragment thereof comprises a light chain comprising a sequence selected from the group consisting of SEQ ID NOs: 963, 967, 971, 975, 979, 983, 987, 991, 995, 999, 1003, 1007, 1011, 1015, 1019, 1023, 1027, 1031, 1035, 1039, 1043, 1047, 1051, 1055, 1059, 1063, 1067, 1071, 1075, 1079, 1083, 1087, 1091, 1095, 1099, 1103, 1107, 1111, 1115, 1119, 1123, 1127, 1131, 1135, 1139, 1143, 1147, 1151, 1155, 1159, 1163, 1167, 1171, 1175, 1179, 1183, 1187, 1191, 1195, 1199, 1288, 1298, 1308, 1318, 1328, 1338, 1348, and 1358 and a heavy chain comprising a sequence selected from the group consisting of SEQ ID NOs: 964, 968, 972, 976, 980, 984, 988, 992, 996, 1000, 1004, 1008, 1012, 1016, 1020, 1024, 1028, 1032, 1036, 1040, 1044, 1048, 1052, 1056, 1060, 1064, 1068, 1072, 1076, 1080, 1084, 1088, 1092, 1096, 1100, 1104, 1108, 1112, 1116, 1120, 1124, 1128, 1132, 1136, 1140, 1144, 1148, 1152, 1156, 1160, 1164, 1168, 1172, 1176, 1180, 1184, 1188, 1192, 1196, 1200, 1289, 1299, 1309, 1319, 1329, 1339, 1349, and 1359. In one embodiment the antibody or fragment thereof comprises a combination of a light chain and a heavy chain selected from the group consisting of a light chain comprising SEQ ID NO: 963 and a heavy chain comprising SEQ ID NO: 964; a light chain comprising SEQ ID NO: 967 and a heavy chain comprising SEQ ID NO: 968; a light chain comprising SEQ ID NO: 971 and a heavy chain comprising SEQ ID NO: 972; a light chain comprising SEQ ID NO: 975 and a heavy chain comprising SEQ ID NO: 976; a light chain comprising SEQ ID NO: 979 and a heavy chain comprising SEQ ID NO: 980; a light chain comprising SEQ ID NO: 983 and a heavy chain comprising SEQ ID NO: 984; a light chain comprising SEQ ID NO: 987 and a heavy chain comprising SEQ ID NO: 988; a light chain comprising SEQ ID NO: 991 and a heavy chain comprising SEQ ID NO: 992; a light chain comprising SEQ ID NO: 995 and a heavy chain comprising SEQ ID NO: 996; a light chain comprising SEQ ID NO: 999 and a heavy chain comprising SEQ ID NO: 1000; a light chain comprising SEQ ID NO: 1003 and a heavy chain comprising SEQ ID NO: 1004; a light chain comprising SEQ ID NO: 1007 and a heavy chain comprising SEQ ID NO: 1008; a light chain comprising SEQ ID NO: 1011 and a heavy chain comprising SEQ ID NO: 1012; a light chain comprising SEQ ID NO: 1015 and a heavy chain comprising SEQ ID NO: 1016; a light chain comprising SEQ ID NO: 1019 and a heavy chain comprising SEQ ID NO: 1020; a light chain comprising SEQ ID NO: 1023 and a heavy chain comprising SEQ ID NO: 1024; a light chain comprising SEQ ID NO: 1027 and a heavy chain comprising SEQ ID NO: 1028; a light chain comprising SEQ ID NO: 1031 and a heavy chain comprising SEQ ID NO: 1032; a light chain comprising SEQ ID NO: 1035 and a heavy chain comprising SEQ ID NO: 1036; a light chain comprising SEQ ID NO: 1039 and a heavy chain comprising SEQ ID NO: 1040; a light chain comprising SEQ ID NO: 1043 and a heavy chain comprising SEQ ID NO: 1044; a light chain comprising SEQ ID NO: 1047 and a heavy chain comprising SEQ ID NO: 1048; a light chain comprising SEQ ID NO: 1051 and a heavy chain comprising SEQ ID NO: 1052; a light chain comprising SEQ ID NO: 1055 and a heavy chain comprising SEQ ID NO: 1056; a light chain comprising SEQ ID NO: 1059 and a heavy chain comprising SEQ ID NO: 1060; a light chain comprising SEQ ID NO: 1063 and a heavy chain comprising SEQ ID NO: 1064; a light chain comprising SEQ ID NO: 1067 and a heavy chain comprising SEQ ID NO: 1068; a light chain comprising SEQ ID NO: 1071 and a heavy chain comprising SEQ ID NO: 1072; a light chain comprising SEQ ID NO: 1075 and a heavy chain comprising SEQ ID NO: 1076; a light chain comprising SEQ ID NO: 1079 and a heavy chain comprising SEQ ID NO: 1080; a light chain comprising SEQ ID NO: 1083 and a heavy chain comprising SEQ ID NO: 1084; a light chain comprising SEQ ID NO: 1087 and a heavy chain comprising SEQ ID NO: 1088; a light chain comprising SEQ ID NO: 1091 and a heavy chain comprising SEQ ID NO: 1092; a light chain comprising SEQ ID NO: 1095 and a heavy chain comprising SEQ ID NO: 1096; a light chain comprising SEQ ID NO: 1099 and a heavy chain comprising SEQ ID NO: 1100; a light chain comprising SEQ ID NO: 1103 and a heavy chain comprising SEQ ID NO: 1104; a light chain comprising SEQ ID NO: 1107 and a heavy chain comprising SEQ ID NO: 1108; a light chain comprising SEQ ID NO: 1111 and a heavy chain comprising SEQ ID NO: 1112; a light chain comprising SEQ ID NO: 1115 and a heavy chain comprising SEQ ID NO: 1116; a light chain comprising SEQ ID NO: 1119 and a heavy chain comprising SEQ ID NO: 1120; a light chain comprising SEQ ID NO: 1123 and a heavy chain comprising SEQ ID NO: 1124; a light chain comprising SEQ ID NO: 1127 and a heavy chain comprising SEQ ID NO: 1128; a light chain comprising SEQ ID NO: 1131 and a heavy chain comprising SEQ ID NO: 1132; a light chain comprising SEQ ID NO: 1135 and a heavy chain comprising SEQ ID NO: 1136; a light chain comprising SEQ ID NO: 1139 and a heavy chain comprising SEQ ID NO: 1140; a light chain comprising SEQ ID NO: 1143 and a heavy chain comprising SEQ ID NO: 1144; a light chain comprising SEQ ID NO: 1147 and a heavy chain comprising SEQ ID NO: 1148; a light chain comprising SEQ ID NO: 1151 and a heavy chain comprising SEQ ID NO: 1152; a light chain comprising SEQ ID NO: 1155 and a heavy chain comprising SEQ ID NO: 1156; a light chain comprising SEQ ID NO: 1159 and a heavy chain comprising SEQ ID NO: 1160; a light chain comprising SEQ ID NO: 1163 and a heavy chain comprising SEQ ID NO: 1164; a light chain comprising SEQ ID NO: 1167 and a heavy chain comprising SEQ ID NO: 1168; a light chain comprising SEQ ID NO: 1171 and a heavy chain comprising SEQ ID NO: 1172; a light chain comprising SEQ ID NO: 1175 and a heavy chain comprising SEQ ID NO: 1176; a light chain comprising SEQ ID NO: 1179 and a heavy chain comprising SEQ ID NO: 1180; a light chain comprising SEQ ID NO: 1183 and a heavy chain comprising SEQ ID NO: 1184; a light chain comprising SEQ ID NO: 1187 and a heavy chain comprising SEQ ID NO: 1188; a light chain comprising SEQ ID NO: 1191 and a heavy chain comprising SEQ ID NO: 1192; a light chain comprising SEQ ID NO: 1195 and a heavy chain comprising SEQ ID NO: 1196; a light chain comprising SEQ ID NO: 1199 and a heavy chain comprising SEQ ID NO: 1200; a light chain comprising SEQ ID NO: 1288 and a heavy chain comprising SEQ ID NO: 1289; a light chain comprising SEQ ID NO: 1298 and a heavy chain comprising SEQ ID NO: 1299; a light chain comprising SEQ ID NO: 1308 and a heavy chain comprising SEQ ID NO: 1309; a light chain comprising SEQ ID NO:

1318 and a heavy chain comprising SEQ ID NO: 1319; a light chain comprising SEQ ID NO: 1328 and a heavy chain comprising SEQ ID NO: 1329; a light chain comprising SEQ ID NO: 1338 and a heavy chain comprising SEQ ID NO: 1339; a light chain comprising SEQ ID NO: 1348 and a heavy chain comprising SEQ ID NO: 1349; and a light chain comprising SEQ ID NO: 1358 and a heavy chain comprising SEQ ID NO: 1359.

In one embodiment the antibody or fragment thereof comprises a light chain encoded by a polynucleotide sequence selected from the group consisting of SEQ ID NOs: 961, 965, 969, 973, 977, 981, 985, 989, 993, 997, 1001, 1005, 1009, 1013, 1017, 1021, 1025, 1029, 1033, 1037, 1041, 1045, 1049, 1053, 1057, 1061, 1065, 1069, 1073, 1077, 1081, 1085, 1089, 1093, 1097, 1101, 1105, 1109, 1113, 1117, 1121, 1125, 1129, 1133, 1137, 1141, 1145, 1149, 1153, 1157, 1161, 1165, 1169, 1173, 1177, 1181, 1185, 1189, 1193, 1197, 1361, 1363, 1365, 1367, 1369, 1371, 1373, and 1375. In one embodiment the antibody or fragment thereof comprises a heavy chain encoded by a polynucleotide sequence selected from the group consisting of SEQ ID NOs: 962, 966, 970, 974, 978, 982, 986, 990, 994, 998, 1002, 1006, 1010, 1014, 1018, 1022, 1026, 1030, 1034, 1038, 1042, 1046, 1050, 1054, 1058, 1062, 1066, 1070, 1074, 1078, 1082, 1086, 1090, 1094, 1098, 1102, 1106, 1110, 1114, 1118, 1122, 1126, 1130, 1134, 1138, 1142, 1146, 1150, 1154, 1158, 1162, 1166, 1170, 1174, 1178, 1182, 1186, 1190, 1194, 1198, 1362, 1364, 1366, 1368, 1370, 1372, 1374, and 1376. In one embodiment the antibody or fragment thereof comprises a light chain encoded by a polynucleotide sequence selected from the group consisting of SEQ ID NOs: 961, 965, 969, 973, 977, 981, 985, 989, 993, 997, 1001, 1005, 1009, 1013, 1017, 1021, 1025, 1029, 1033, 1037, 1041, 1045, 1049, 1053, 1057, 1061, 1065, 1069, 1073, 1077, 1081, 1085, 1089, 1093, 1097, 1101, 1105, 1109, 1113, 1117, 1121, 1125, 1129, 1133, 1137, 1141, 1145, 1149, 1153, 1157, 1161, 1165, 1169, 1173, 1177, 1181, 1185, 1189, 1193, 1197, 1361, 1363, 1365, 1367, 1369, 1371, 1373, and 1375 and a heavy chain comprising a sequence selected from the group consisting of SEQ ID NOs: 962, 966, 970, 974, 978, 982, 986, 990, 994, 998, 1002, 1006, 1010, 1014, 1018, 1022, 1026, 1030, 1034, 1038, 1042, 1046, 1050, 1054, 1058, 1062, 1066, 1070, 1074, 1078, 1082, 1086, 1090, 1094, 1098, 1102, 1106, 1110, 1114, 1118, 1122, 1126, 1130, 1134, 1138, 1142, 1146, 1150, 1154, 1158, 1162, 1166, 1170, 1174, 1178, 1182, 1186, 1190, 1194, 1198, 1362, 1364, 1366, 1368, 1370, 1372, 1374, and 1376. In one embodiment the antibody or fragment thereof comprises a combination of light chain variable region and a heavy chain variable region selected from the group consisting of a light chain encoded by a polynucleotide sequence comprising SEQ ID NO: 961 and a heavy chain encoded by a polynucleotide sequence comprising SEQ ID NO: 962; a light chain encoded by a polynucleotide sequence comprising SEQ ID NO: 965 and a heavy chain encoded by a polynucleotide sequence comprising SEQ ID NO: 966; a light chain encoded by a polynucleotide sequence comprising SEQ ID NO: 969 and a heavy chain encoded by a polynucleotide sequence comprising SEQ ID NO: 970; a light chain encoded by a polynucleotide sequence comprising SEQ ID NO: 973 and a heavy chain encoded by a polynucleotide sequence comprising SEQ ID NO: 974; a light chain encoded by a polynucleotide sequence comprising SEQ ID NO: 977 and a heavy chain encoded by a polynucleotide sequence comprising SEQ ID NO: 978; a light chain encoded by a polynucleotide sequence comprising SEQ ID NO: 981 and a heavy chain encoded by a polynucleotide sequence comprising SEQ ID NO: 982; a light chain encoded by a polynucleotide sequence comprising SEQ ID NO: 985 and a heavy chain encoded by a polynucleotide sequence comprising SEQ ID NO: 986; a light chain encoded by a polynucleotide sequence comprising SEQ ID NO: 989 and a heavy chain encoded by a polynucleotide sequence comprising SEQ ID NO: 990; a light chain encoded by a polynucleotide sequence comprising SEQ ID NO: 993 and a heavy chain encoded by a polynucleotide sequence comprising SEQ ID NO: 994; a light chain encoded by a polynucleotide sequence comprising SEQ ID NO: 997 and a heavy chain encoded by a polynucleotide sequence comprising SEQ ID NO: 998; a light chain encoded by a polynucleotide sequence comprising SEQ ID NO: 1001 and a heavy chain encoded by a polynucleotide sequence comprising SEQ ID NO: 1002; a light chain encoded by a polynucleotide sequence comprising SEQ ID NO: 1005 and a heavy chain encoded by a polynucleotide sequence comprising SEQ ID NO: 1006; a light chain encoded by a polynucleotide sequence comprising SEQ ID NO: 1009 and a heavy chain encoded by a polynucleotide sequence comprising SEQ ID NO: 1010; a light chain encoded by a polynucleotide sequence comprising SEQ ID NO: 1013 and a heavy chain encoded by a polynucleotide sequence comprising SEQ ID NO: 1014; a light chain encoded by a polynucleotide sequence comprising SEQ ID NO: 1017 and a heavy chain encoded by a polynucleotide sequence comprising SEQ ID NO: 1018; a light chain encoded by a polynucleotide sequence comprising SEQ ID NO: 1021 and a heavy chain encoded by a polynucleotide sequence comprising SEQ ID NO: 1022; a light chain encoded by a polynucleotide sequence comprising SEQ ID NO: 1025 and a heavy chain encoded by a polynucleotide sequence comprising SEQ ID NO: 1026; a light chain encoded by a polynucleotide sequence comprising SEQ ID NO: 1029 and a heavy chain encoded by a polynucleotide sequence comprising SEQ ID NO: 1030; a light chain encoded by a polynucleotide sequence comprising SEQ ID NO: 1033 and a heavy chain encoded by a polynucleotide sequence comprising SEQ ID NO: 1034; a light chain encoded by a polynucleotide sequence comprising SEQ ID NO: 1037 and a heavy chain encoded by a polynucleotide sequence comprising SEQ ID NO: 1038; a light chain encoded by a polynucleotide sequence comprising SEQ ID NO: 1041 and a heavy chain encoded by a polynucleotide sequence comprising SEQ ID NO: 1042; a light chain encoded by a polynucleotide sequence comprising SEQ ID NO: 1045 and a heavy chain encoded by a polynucleotide sequence comprising SEQ ID NO: 1046; a light chain encoded by a polynucleotide sequence comprising SEQ ID NO: 1049 and a heavy chain encoded by a polynucleotide sequence comprising SEQ ID NO: 1050; a light chain encoded by a polynucleotide sequence comprising SEQ ID NO: 1053 and a heavy chain encoded by a polynucleotide sequence comprising SEQ ID NO: 1054; a light chain encoded by a polynucleotide sequence comprising SEQ ID NO: 1057 and a heavy chain encoded by a polynucleotide sequence comprising SEQ ID NO: 1058; a light chain encoded by a polynucleotide sequence comprising SEQ ID NO: 1061 and a heavy chain encoded by a polynucleotide sequence comprising SEQ ID NO: 1062; a light chain encoded by a polynucleotide sequence comprising SEQ ID NO: 1065 and a heavy chain encoded by a polynucleotide sequence comprising SEQ ID NO: 1066; a light chain encoded by a polynucleotide sequence comprising SEQ ID NO: 1069 and a heavy chain encoded by a polynucleotide sequence comprising SEQ ID NO: 1070; a light chain encoded by a polynucleotide sequence comprising SEQ ID NO: 1073 and a heavy chain encoded by a polynucleotide sequence comprising SEQ ID NO: 1074; a light chain encoded by a polynucleotide sequence comprising SEQ ID NO: 1077 and a heavy chain encoded by a polynucleotide sequence comprising SEQ ID NO: 1078; a light chain encoded by a polynucleotide sequence comprising SEQ ID NO: 1081 and a heavy chain encoded by a polynucleotide sequence comprising SEQ ID NO: 1082; a light chain encoded by a polynucleotide sequence comprising SEQ ID NO: 1085 and a heavy chain encoded by a polynucleotide sequence comprising SEQ ID NO: 1086; a light chain encoded by a polynucleotide sequence comprising SEQ ID NO: 1089 and a heavy chain encoded by a polynucleotide sequence comprising SEQ ID NO: 1090; a light chain encoded by a polynucleotide sequence comprising SEQ ID NO: 1093 and a heavy chain encoded by a polynucleotide sequence comprising SEQ ID NO: 1094; a light chain encoded by a polynucleotide sequence comprising SEQ ID NO: 1097 and a heavy chain encoded by a polynucleotide sequence comprising SEQ ID NO: 1098; a light chain encoded by a polynucleotide sequence comprising SEQ ID NO: 1101 and a heavy chain encoded by a polynucleotide sequence comprising SEQ ID NO: 1102; a light chain encoded by a polynucleotide sequence comprising SEQ ID NO: 1105 and a heavy chain encoded by a polynucleotide sequence comprising SEQ ID NO: 1106; a light chain encoded by a polynucleotide sequence comprising SEQ ID NO: 1109 and a heavy chain encoded by a polynucleotide sequence comprising SEQ ID NO: 1110; a light chain encoded by a polynucleotide sequence comprising SEQ ID NO: 1113 and a heavy chain encoded by a polynucleotide sequence comprising SEQ ID NO: 1114; a light chain encoded by a polynucleotide sequence comprising SEQ ID NO: 1117 and a heavy chain encoded by a polynucleotide sequence comprising SEQ ID NO: 1118; a light chain encoded by a polynucleotide sequence comprising SEQ ID NO: 1121 and a heavy chain encoded by a polynucleotide sequence comprising SEQ ID NO: 1122; a light chain encoded by a polynucleotide sequence comprising SEQ ID NO: 1125 and a heavy chain encoded by a polynucleotide sequence comprising SEQ ID NO: 1126; a light chain encoded by a polynucleotide sequence comprising SEQ ID NO: 1129 and a heavy chain encoded by a polynucleotide sequence comprising SEQ ID NO: 1130; a light chain encoded by a polynucleotide sequence comprising SEQ ID NO: 1133 and a heavy chain encoded by a polynucleotide sequence comprising SEQ ID NO: 1134; a light chain encoded by a polynucleotide sequence comprising SEQ ID NO: 1137 and a heavy chain encoded by a polynucleotide sequence comprising SEQ ID NO: 1138; a light chain encoded by a polynucleotide sequence comprising SEQ ID NO: 1141 and a heavy chain encoded by a polynucleotide sequence comprising SEQ ID NO: 1142; a light chain encoded by a polynucleotide sequence comprising SEQ ID NO: 1145 and a heavy chain encoded by a polynucleotide sequence comprising SEQ ID NO: 1146; a light chain encoded by a polynucleotide sequence comprising SEQ ID NO: 1149 and a heavy chain encoded by a polynucleotide sequence comprising SEQ ID NO: 1150; a light chain encoded by a polynucleotide sequence comprising SEQ ID NO: 1153 and a heavy chain encoded by a polynucleotide sequence comprising SEQ ID NO: 1154; a light chain encoded by a polynucleotide sequence comprising SEQ ID NO: 1157 and a heavy chain encoded by a polynucleotide sequence comprising SEQ ID NO: 1158; a light chain encoded by a polynucleotide sequence comprising SEQ ID NO: 1161 and a heavy chain encoded by a polynucleotide sequence comprising SEQ ID NO: 1162; a light chain encoded by a polynucleotide sequence comprising SEQ ID NO: 1165 and a heavy chain encoded by a polynucleotide sequence comprising SEQ ID NO: 1166; a light chain encoded by a polynucleotide sequence comprising SEQ ID NO: 1169 and a heavy chain encoded by a polynucleotide sequence comprising SEQ ID NO: 1170; a light chain encoded by a polynucleotide sequence comprising SEQ ID NO: 1173 and a heavy chain encoded by a polynucleotide sequence comprising SEQ ID NO: 1174; a light chain encoded by a polynucleotide sequence comprising SEQ ID NO: 1177 and a heavy chain encoded by a polynucleotide sequence comprising SEQ ID NO: 1178; a light chain encoded by a polynucleotide sequence comprising SEQ ID NO: 1181 and a heavy chain encoded by a polynucleotide sequence comprising SEQ ID NO: 1182; a light chain encoded by a polynucleotide sequence comprising SEQ ID NO: 1185 and a heavy chain encoded by a polynucleotide sequence comprising SEQ ID NO: 1186; a light chain encoded by a polynucleotide sequence comprising SEQ ID NO: 1189 and a heavy chain encoded by a polynucleotide sequence comprising SEQ ID NO: 1190; a light chain encoded by a polynucleotide sequence comprising SEQ ID NO: 1193 and a heavy chain encoded by a polynucleotide sequence comprising SEQ ID NO: 1194; a light chain encoded by a polynucleotide sequence comprising SEQ ID NO: 1197 and a heavy chain encoded by a polynucleotide sequence comprising SEQ ID NO: 1198; a light chain encoded by a polynucleotide sequence comprising SEQ ID NO: 1361 and a heavy chain encoded by a polynucleotide sequence comprising SEQ ID NO: 1362; a light chain encoded by a polynucleotide sequence comprising SEQ ID NO: 1363 and a heavy chain encoded by a polynucleotide sequence comprising SEQ ID NO: 1364; a light chain encoded by a polynucleotide sequence comprising SEQ ID NO: 1365 and a heavy chain encoded by a polynucleotide sequence comprising SEQ ID NO: 1366; a light chain encoded by a polynucleotide sequence comprising SEQ ID NO: 1367 and a heavy chain encoded by a polynucleotide sequence comprising SEQ ID NO: 1368; a light chain encoded by a polynucleotide sequence comprising SEQ ID NO: 1369 and a heavy chain encoded by a polynucleotide sequence comprising SEQ ID NO: 1370; a light chain encoded by a polynucleotide sequence comprising SEQ ID NO: 1371 and a heavy chain encoded by a polynucleotide sequence comprising SEQ ID NO: 1372; a light chain encoded by a polynucleotide sequence comprising SEQ ID NO: 1373 and a heavy chain encoded by a polynucleotide sequence comprising SEQ ID NO: 1374; and a light chain encoded by a polynucleotide sequence comprising SEQ ID NO: 1375 and a heavy chain encoded by a polynucleotide sequence comprising SEQ ID NO: 1376.

In some aspects, the invention comprises an antibody that binds to GIPR, wherein the antibody binds to GIPR and reduces the likelihood that GIPR binds to GIP.

In another aspect, the antigen binding protein comprises a full length light chain and a full length heavy chain as listed in one of the rows for one of the antibodies listed in TABLE 5. Some antigen binding proteins that are provided comprise a full length light chain and a full length heavy chain as listed in one of the rows for one of the antibodies listed in TABLE 5, except that one or both of the chains differs from the sequence specified in the table at only 1, 2, 3, 4, 5, 6, 7, 8, 9, 10, 11, 12, 13, 14 or 15 amino acid residues, wherein each such sequence difference is independently either a single amino acid deletion, insertion or substitution, with the deletions, insertions and/or substitutions resulting in no more than 1, 2, 3, 4, 5, 6, 7, 8, 9, 10, 11, 12, 13, 14 or 15 amino acid changes relative to the full length sequences specified in TABLE 5. In one embodiment the antigen binding protein comprises a full length light chain and/or a full length heavy chain from Table 5 with the N-terminal methionine deleted. In one embodiment the antigen binding protein comprises a full length light chain and/or a full length heavy chain from Table 5 with the C-terminal lysine deleted. Other antigen binding proteins also comprise a full length light chain and a full length heavy chain as listed in one of the rows for one of the antibodies listed in TABLE 5, except that one or both of the chains differs from the sequence specified in the table in that the light chain and/or heavy chain comprises or consists of a sequence of amino acids that has at least 70%, 75%, 80%, 85%, 90%, 95%, 96%, 97%, 98%, or 99% sequence identity to the amino acid sequences of the light chain or heavy chain sequences as specified in TABLE 5.

In another embodiment, the antigen binding protein consists of a just a light or a heavy chain polypeptide as set forth in TABLE 5.

In still another aspect, antigen-binding proteins containing the CDRs, variable domains and/or full length sequences listed in TABLES 3, 4A, 4B, and 5 is a monoclonal antibody, a chimeric antibody, a humanized antibody, a human antibody, a multispecific antibody, or an antibody fragment of the foregoing. In another embodiment, the antibody fragment of the isolated antigen-binding proteins provided herein is a Fab fragment, a Fab' fragment, an F(ab')2 fragment, an Fv fragment, a diabody, or a scFv based upon an antibody with the sequences as listed in TABLE 5.

In yet another aspect, the isolated antigen-binding protein provided in TABLE 5 can be coupled to a labeling group and can compete for binding to GIPR with an antigen binding protein of one of the isolated antigen-binding proteins provided herein.

In another embodiment, antigen binding proteins are provided that compete with one of the exemplified antibodies or functional fragments described above for specific binding to a human GIPR (e.g., SEQ ID NO: 1201). Such antigen binding proteins may bind to the same epitope as one of the antigen binding proteins described herein, or to an overlapping epitope. Antigen binding proteins and fragments that compete with the exemplified antigen binding proteins are expected to show similar functional properties. The exemplified antigen binding proteins and fragments include those described above, including those with heavy and light chains, variable region domains and CDRs included in TABLES 3, 4A, 4B, and 5. Thus, as a specific example, the antigen binding proteins that are provided include those that compete with an antibody having:

- all 6 of the CDRs listed for any antibody listed in TABLES 4A and 4B;
- a VH and a VL listed for any antibody listed in TABLE 3; or
- two light chains and two heavy chains as specified for any antibody listed in TABLE 5.

The antigen binding proteins that are provided include monoclonal antibodies that bind to GIPR. Monoclonal antibodies may be produced using any technique known in the art, e.g., by immortalizing spleen cells harvested from the transgenic animal after completion of the immunization schedule. The spleen cells can be immortalized using any technique known in the art, e.g., by fusing them with myeloma cells to produce hybridomas. Myeloma cells for use in hybridoma-producing fusion procedures preferably are non-antibody-producing, have high fusion efficiency, and enzyme deficiencies that render them incapable of growing in certain selective media which support the growth of only the desired fused cells (hybridomas). Examples of suitable cell lines for use in mouse fusions include Sp-20, P3-X63/Ag8, P3-X63-Ag8.653, NS1/1.Ag 4 1, Sp210-Ag14, FO, NSO/U, MPC-11, MPC11-X45-GTG 1.7 and S194/5XXO Bul; examples of cell lines used in rat fusions include R210.RCY3, Y3-Ag 1.2.3, IR983F and 4B210. Other cell lines useful for cell fusions are U-266, GM1500-GRG2, LICR-LON-HMy2 and UC729-6.

In some instances, a hybridoma cell line is produced by immunizing an animal (e.g., a transgenic animal having human immunoglobulin sequences) with a GIPR immunogen; harvesting spleen cells from the immunized animal; fusing the harvested spleen cells to a myeloma cell line, thereby generating hybridoma cells; establishing hybridoma cell lines from the hybridoma cells, and identifying a hybridoma cell line that produces an antibody that binds a GIPR polypeptide. Such hybridoma cell lines, and anti-GIPR monoclonal antibodies produced by them, are aspects of the present application.

Monoclonal antibodies secreted by a hybridoma cell line can be purified using any technique known in the art. Hybridomas or mAbs may be further screened to identify mAbs with particular properties, such as the ability to increase GIPR activity.

Chimeric and humanized antibodies based upon the foregoing sequences are also provided. Monoclonal antibodies for use as therapeutic agents may be modified in various ways prior to use. One example is a chimeric antibody, which is an antibody composed of protein segments from different antibodies that are covalently joined to produce functional immunoglobulin light or heavy chains or immunologically functional portions thereof. Generally, a portion of the heavy chain and/or light chain is identical with or homologous to a corresponding sequence in antibodies derived from a particular species or belonging to a particular antibody class or subclass, while the remainder of the chain(s) is/are identical with or homologous to a corresponding sequence in antibodies derived from another species or belonging to another antibody class or subclass. For methods relating to chimeric antibodies, see, for example, U.S. Pat. No. 4,816,567; and Morrison et al., 1985, Proc. Natl. Acad. Sci. USA 81:6851-6855, which are hereby incorporated by reference. CDR grafting is described, for example, in U.S. Pat. Nos. 6,180,370, 5,693,762, 5,693,761, 5,585,089, and 5,530,101.

Generally, the goal of making a chimeric antibody is to create a chimera in which the number of amino acids from the intended patient species is maximized. One example is the "CDR-grafted" antibody, in which the antibody comprises one or more complementarity determining regions (CDRs) from a particular species or belonging to a particular antibody class or subclass, while the remainder of the antibody chain(s) is/are identical with or homologous to a corresponding sequence in antibodies derived from another species or belonging to another antibody class or subclass. For use in humans, the variable region or selected CDRs from a rodent antibody often are grafted into a human antibody, replacing the naturally-occurring variable regions or CDRs of the human antibody.

One useful type of chimeric antibody is a "humanized" antibody. Generally, a humanized antibody is produced from a monoclonal antibody raised initially in a non-human animal. Certain amino acid residues in this monoclonal antibody, typically from non-antigen recognizing portions of the antibody, are modified to be homologous to corresponding residues in a human antibody of corresponding isotype. Humanization can be performed, for example, using various methods by substituting at least a portion of a rodent variable region for the corresponding regions of a human antibody (see, e.g., U.S. Pat. Nos. 5,585,089, and 5,693,762; Jones et al., 1986, *Nature* 321:522-525; Riechmann et al., 1988, *Nature* 332:323-27; Verhoeyen et al., 1988, *Science* 239: 1534-1536).

In one aspect, the CDRs of the light and heavy chain variable regions of the antibodies provided herein are grafted to framework regions (FRs) from antibodies from the same, or a different, phylogenetic species. For example, the CDRs of the heavy and light chain variable regions $V_H1$, $V_H2$, $V_H3$, $V_H4$, $V_H5$, $V_H6$, $V_H7$, $V_H8$, $V_H9$, $V_H10$, $V_H11$, $V_H12$ and/or $V_L1$, and $V_L2$ can be grafted to consensus human FRs. To create consensus human FRs, FRs from several human heavy chain or light chain amino acid sequences may be aligned to identify a consensus amino acid sequence. In other embodiments, the FRs of a heavy chain or light chain disclosed herein are replaced with the FRs from a different heavy chain or light chain. In one aspect, rare amino acids in the FRs of the heavy and light chains of GIPR antibodies are not replaced, while the rest of the FR amino acids are replaced. A "rare amino acid" is a specific amino acid that is in a position in which this particular amino acid is not usually found in an FR. Alternatively, the grafted variable regions from the one heavy or light chain may be used with a constant region that is different from the constant region of that particular heavy or light chain as disclosed herein. In other embodiments, the grafted variable regions are part of a single chain Fv antibody.

In certain embodiments, constant regions from species other than human can be used along with the human variable region(s) to produce hybrid antibodies.

Fully human GIPR antibodies are also provided. Methods are available for making fully human antibodies specific for a given antigen without exposing human beings to the antigen ("fully human antibodies"). One specific means provided for implementing the production of fully human antibodies is the "humanization" of the mouse humoral immune system. Introduction of human immunoglobulin (Ig) loci into mice in which the endogenous Ig genes have been inactivated is one means of producing fully human monoclonal antibodies (mAbs) in mouse, an animal that can be immunized with any desirable antigen. Using fully human antibodies can minimize the immunogenic and allergic responses that can sometimes be caused by administering mouse or mouse-derived mAbs to humans as therapeutic agents.

Fully human antibodies can be produced by immunizing transgenic animals (usually mice) that are capable of producing a repertoire of human antibodies in the absence of endogenous immunoglobulin production. Antigens for this purpose typically have six or more contiguous amino acids, and optionally are conjugated to a carrier, such as a hapten. See, e.g., Jakobovits et al., 1993, *Proc. Natl. Acad. Sci. USA* 90:2551-2555; Jakobovits et al., 1993, *Nature* 362:255-258; and Bruggermann et al., 1993, *Year in Immunol.* 7:33. In one example of such a method, transgenic animals are produced by incapacitating the endogenous mouse immunoglobulin loci encoding the mouse heavy and light immunoglobulin chains therein, and inserting into the mouse genome large fragments of human genome DNA containing loci that encode human heavy and light chain proteins. Partially modified animals, which have less than the full complement of human immunoglobulin loci, are then cross-bred to obtain an animal having all of the desired immune system modifications. When administered an immunogen, these transgenic animals produce antibodies that are immunospecific for the immunogen but have human rather than murine amino acid sequences, including the variable regions. For further details of such methods, see, for example, WO96/33735 and WO94/02602. Additional methods relating to transgenic mice for making human antibodies are described in U.S. Pat. Nos. 5,545,807; 6,713,610; 6,673,986; 6,162,963; 5,545,807; 6,300,129; 6,255,458; 5,877,397; 5,874,299 and 5,545,806; in PCT publications WO91/10741, WO90/04036, and in EP 546073B1 and EP 546073A1.

The transgenic mice described above, referred to herein as "HuMab" mice, contain a human immunoglobulin gene minilocus that encodes unrearranged human heavy ([mu] and [gamma]) and [kappa] light chain immunoglobulin sequences, together with targeted mutations that inactivate the endogenous [mu] and [kappa] chain loci (Lonberg et al., 1994, *Nature* 368:856-859). Accordingly, the mice exhibit reduced expression of mouse IgM or [kappa] and in response to immunization, and the introduced human heavy and light chain transgenes undergo class switching and somatic mutation to generate high affinity human IgG [kappa] monoclonal antibodies (Lonberg et al., supra.; Lonberg and Huszar, 1995, *Intern. Rev. Immunol.* 13: 65-93; Harding and Lonberg, 1995, *Ann. N.Y Acad. Sci.* 764:536-546). The preparation of HuMab mice is described in detail in Taylor et al., 1992, *Nucleic Acids Research* 20:6287-6295; Chen et al., 1993, *International Immunology* 5:647-656; Tuaillon et al., 1994, *J. Immunol.* 152:2912-2920; Lonberg et al., 1994, *Nature* 368:856-859; Lonberg, 1994, *Handbook of Exp. Pharmacology* 113:49-101; Taylor et al., 1994, *International Immunology* 6:579-591; Lonberg and Huszar, 1995, *Intern. Rev. Immunol.* 13:65-93; Harding and Lonberg, 1995, *Ann. N.Y Acad Sci.* 764:536-546; Fishwild et al., 1996, *Nature Biotechnology* 14:845-851; the foregoing references are hereby incorporated by reference in their entirety for all purposes. See, further U.S. Pat. Nos. 5,545,806; 5,569,825; 5,625,126; 5,633,425; 5,789,650; 5,877,397; 5,661,016; 5,814,318; 5,874,299; and 5,770,429; as well as U.S. Pat. No. 5,545,807; International Publication Nos. WO 93/1227; WO 92/22646; and WO 92/03918, the disclosures of all of which are hereby incorporated by reference in their entirety for all purposes. Technologies utilized for producing human antibodies in these transgenic mice are disclosed also in WO 98/24893, and Mendez et al., 1997, *Nature Genetics* 15:146-156, which are hereby incorporated by reference. For example, the HCo7 and HCo12 transgenic mice strains can be used to generate human monoclonal antibodies against GIPR. Further details regarding the production of human antibodies using transgenic mice are provided below.

Using hybridoma technology, antigen-specific human mAbs with the desired specificity can be produced and selected from the transgenic mice such as those described above. Such antibodies may be cloned and expressed using a suitable vector and host cell, or the antibodies can be harvested from cultured hybridoma cells.

Fully human antibodies can also be derived from phage-display libraries (as disclosed in Hoogenboom et al., 1991, *J. Mol. Biol.* 227:381; and Marks et al., 1991, *J. Mol. Biol.* 222:581). Phage display techniques mimic immune selection through the display of antibody repertoires on the surface of filamentous bacteriophage, and subsequent selection of phage by their binding to an antigen of choice. One such technique is described in PCT Publication No. WO 99/10494 (hereby incorporated by reference).

The GIPR binding protein can also be a variant, mimetic, derivative or oligomer based upon the structure of GIPR antigen binding proteins have the CDRs, variable regions and/or full length chains as described above.

In one embodiment, for instance, an antigen binding protein is a variant form of the antigen binding proteins disclosed above. For instance, some of the antigen binding proteins have one or more conservative amino acid substitutions in one or more of the heavy or light chains, variable regions or CDRs.

Naturally-occurring amino acids may be divided into classes based on common side chain properties:

1) hydrophobic: norleucine, Met, Ala, Val, Leu, Ile;
2) neutral hydrophilic: Cys, Ser, Thr, Asn, Gln;
3) acidic: Asp, Glu;
4) basic: His, Lys, Arg;
5) residues that influence chain orientation: Gly, Pro; and
6) aromatic: Trp, Tyr, Phe.

Conservative amino acid substitutions may involve exchange of a member of one of these classes with another member of the same class. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties.

Non-conservative substitutions may involve the exchange of a member of one of the above classes for a member from another class. Such substituted residues may be introduced into regions of the antibody that are homologous with human antibodies, or into the non-homologous regions of the molecule.

In making such changes, according to certain embodiments, the hydropathic index of amino acids may be considered. The hydropathic profile of a protein is calculated by assigning each amino acid a numerical value ("hydropathy index") and then repetitively averaging these values along the peptide chain. Each amino acid has been assigned a hydropathic index on the basis of its hydrophobicity and charge characteristics. They are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic profile in conferring interactive biological function on a protein is understood in the art (see, e.g., Kyte et al., 1982, *J. Mol. Biol.* 157:105-131). It is known that certain amino acids may be substituted for other amino acids having a similar hydropathic index or score and still retain a similar biological activity. In making changes based upon the hydropathic index, in certain embodiments, the substitution of amino acids whose hydropathic indices are within ±2 is included. In some aspects, those which are within ±1 are included, and in other aspects, those within ±0.5 are included.

It is also understood in the art that the substitution of like amino acids can be made effectively on the basis of hydrophilicity, particularly where the biologically functional protein or peptide thereby created is intended for use in immunological embodiments, as in the present case. In certain embodiments, the greatest local average hydrophilicity of a protein, as governed by the hydrophilicity of its adjacent amino acids, correlates with its immunogenicity and antigen-binding or immunogenicity, that is, with a biological property of the protein.

The following hydrophilicity values have been assigned to these amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). In making changes based upon similar hydrophilicity values, in certain embodiments, the substitution of amino acids whose hydrophilicity values are within ±2 is included, in other embodiments, those which are within ±1 are included, and in still other embodiments, those within ±0.5 are included. In some instances, one may also identify epitopes from primary amino acid sequences on the basis of hydrophilicity. These regions are also referred to as "epitopic core regions."

Exemplary conservative amino acid substitutions are set forth in Table 6.

TABLE 8

| Conservative Amino Acid Substitutions | |
|---|---|
| Original Residue | Exemplary Substitutions |
| Ala | Ser |
| Arg | Lys |
| Asn | Gln, His |
| Asp | Glu |
| Cys | Ser |
| Gln | Asn |
| Glu | Asp |
| Gly | Pro |
| His | Asn, Gln |
| Ile | Leu, Val |
| Leu | Ile, Val |
| Lys | Arg, Gln, Glu |
| Met | Leu, Ile |
| Phe | Met, Leu, Tyr |
| Ser | Thr |
| Thr | Ser |
| Trp | Tyr |
| Tyr | Trp, Phe |
| Val | Ile, Leu |

A skilled artisan will be able to determine suitable variants of polypeptides as set forth herein using well-known techniques. One skilled in the art may identify suitable areas of the molecule that may be changed without destroying activity by targeting regions not believed to be important for activity. The skilled artisan also will be able to identify residues and portions of the molecules that are conserved among similar polypeptides. In further embodiments, even areas that may be important for biological activity or for structure may be subject to conservative amino acid substitutions without destroying the biological activity or without adversely affecting the polypeptide structure.

Additionally, one skilled in the art can review structure-function studies identifying residues in similar polypeptides that are important for activity or structure. In view of such a comparison, one can predict the importance of amino acid residues in a protein that correspond to amino acid residues important for activity or structure in similar proteins. One skilled in the art may opt for chemically similar amino acid substitutions for such predicted important amino acid residues.

One skilled in the art can also analyze the 3-dimensional structure and amino acid sequence in relation to that structure in similar polypeptides. In view of such information, one skilled in the art may predict the alignment of amino acid residues of an antibody with respect to its three dimensional structure. One skilled in the art may choose not to make radical changes to amino acid residues predicted to be on the surface of the protein, since such residues may be involved in important interactions with other molecules. Moreover, one skilled in the art may generate test variants containing a single amino acid substitution at each desired amino acid residue. These variants can then be screened using assays for GIPR activity, thus yielding information regarding which amino acids can be changed and which must not be changed. In other words, based on information gathered from such routine experiments, one skilled in the art can readily determine the amino acid positions where further substitutions should be avoided either alone or in combination with other mutations.

A number of scientific publications have been devoted to the prediction of secondary structure. See, Moult, 1996, *Curr. Op. in Biotech.* 7:422-427; Chou et al., 1974, *Biochem.* 13:222-245; Chou et al., 1974, *Biochemistry* 113:211-222; Chou et al., 1978, *Adv. Enzymol. Relat. Areas Mol. Biol.* 47:45-148; Chou et al., 1979, *Ann. Rev. Biochem.* 47:251-276; and Chou et al., 1979, *Biophys. J.* 26:367-384. Moreover, computer programs are currently available to assist with predicting secondary structure. One method of predicting secondary structure is based upon homology modeling. For example, two polypeptides or proteins that have a sequence identity of greater than 30%, or similarity greater than 40% can have similar structural topologies. The recent growth of the protein structural database (PDB) has provided enhanced predictability of secondary structure, including the potential number of folds within a polypeptide's or protein's structure. See, Holm et al., 1999, *Nucl. Acid. Res.* 27:244-247. It has been suggested (Brenner et al., 1997, *Curr. Op. Struct. Biol.* 7:369-376) that there are a limited number of folds in a given polypeptide or protein and that once a critical number of structures have been resolved, structural prediction will become dramatically more accurate.

Additional methods of predicting secondary structure include "threading" (Jones, 1997, *Curr. Opin. Struct. Biol.* 7:377-387; Sippl et al., 1996, *Structure* 4:15-19), "profile analysis" (Bowie et al., 1991, *Science* 253:164-170; Gribskov et al., 1990, *Meth. Enzym.* 183:146-159; Gribskov et al., 1987, *Proc. Nat. Acad. Sci.* 84:4355-4358), and "evolutionary linkage" (See, Holm, 1999, supra; and Brenner, 1997, supra).

In some embodiments, amino acid substitutions are made that: (1) reduce susceptibility to proteolysis, (2) reduce susceptibility to oxidation, (3) alter binding affinity for forming protein complexes, (4) alter ligand or antigen binding affinities, and/or (4) confer or modify other physicochemical or functional properties on such polypeptides. For example, single or multiple amino acid substitutions (in certain embodiments, conservative amino acid substitutions) may be made in the naturally-occurring sequence. Substitutions can be made in that portion of the antibody that lies outside the domain(s) forming intermolecular contacts). In such embodiments, conservative amino acid substitutions can be used that do not substantially change the structural characteristics of the parent sequence (e.g., one or more replacement amino acids that do not disrupt the secondary structure that characterizes the parent or native antigen binding protein). Examples of art-recognized polypeptide secondary and tertiary structures are described in Proteins, Structures and Molecular Principles (Creighton, Ed.), 1984, W. H. New York: Freeman and Company; Introduction to Protein Structure (Branden and Tooze, eds.), 1991, New York: Garland Publishing; and Thornton et al., 1991, *Nature* 354:105, which are each incorporated herein by reference.

Additional preferred antibody variants include cysteine variants wherein one or more cysteine residues in the parent or native amino acid sequence are deleted from or substituted with another amino acid (e.g., serine). Cysteine variants are useful, inter alia when antibodies must be refolded into a biologically active conformation. Cysteine variants may have fewer cysteine residues than the native antibody, and typically have an even number to minimize interactions resulting from unpaired cysteines.

The heavy and light chains, variable regions domains and CDRs that are disclosed can be used to prepare polypeptides that contain an antigen binding region that can specifically bind to GIPR. For example, one or more of the CDRs can be incorporated into a molecule (e.g., a polypeptide) covalently or noncovalently to make an immunoadhesion. An immunoadhesion may incorporate the CDR(s) as part of a larger polypeptide chain, may covalently link the CDR(s) to another polypeptide chain, or may incorporate the CDR(s) noncovalently. The CDR(s) enable the immunoadhesion to bind specifically to a particular antigen of interest (e.g., an GIPR polypeptide or epitope thereof).

Mimetics (e.g., "peptide mimetics" or "peptidomimetics") based upon the variable region domains and CDRs that are described herein are also provided. These analogs can be peptides, non-peptides or combinations of peptide and non-peptide regions. Fauchere, 1986, *Adv. Drug Res.* 15:29; Veber and Freidinger, 1985, *TINS* p. 392; and Evans et al., 1987, *J. Med. Chem.* 30:1229, which are incorporated herein by reference for any purpose. Peptide mimetics that are structurally similar to therapeutically useful peptides may be used to produce a similar therapeutic or prophylactic effect. Such compounds are often developed with the aid of computerized molecular modeling. Generally, peptidomimetics are proteins that are structurally similar to an antibody displaying a desired biological activity, such as here the ability to specifically bind GIPR, but have one or more peptide linkages optionally replaced by a linkage selected from: —$CH_2NH$—, —$CH_2S$—, —$CH_2$—$CH_2$—, —CH—CH-(cis and trans), —$COCH_2$—, —$CH(OH)CH_2$—, and —$CH_2SO$—, by methods well known in the art. Systematic substitution of one or more amino acids of a consensus sequence with a D-amino acid of the same type (e.g., D-lysine in place of L-lysine) may be used in certain embodiments to generate more stable proteins. In addition, constrained peptides comprising a consensus sequence or a substantially identical consensus sequence variation may be generated by methods known in the art (Rizo and Gierasch, 1992, *Ann. Rev. Biochem.* 61:387), incorporated herein by reference), for example, by adding internal cysteine residues capable of forming intramolecular disulfide bridges which cyclize the peptide.

Derivatives of the antigen binding proteins that are described herein are also provided. The derivatized antigen binding proteins can comprise any molecule or substance that imparts a desired property to the antibody or fragment, such as increased half-life in a particular use. The derivatized antigen binding protein can comprise, for example, a detectable (or labeling) moiety (e.g., a radioactive, colorimetric, antigenic or enzymatic molecule, a detectable bead (such as a magnetic or electrodense (e.g., gold) bead), or a molecule that binds to another molecule (e.g., biotin or streptavidin)), a therapeutic or diagnostic moiety (e.g., a radioactive, cytotoxic, or pharmaceutically active moiety), or a molecule that increases the suitability of the antigen binding protein for a particular use (e.g., administration to a subject, such as a human subject, or other in vivo or in vitro uses). Examples of molecules that can be used to derivatize an antigen binding protein include albumin (e.g., human serum albumin) and polyethylene glycol (PEG). Albumin-linked and PEGylated derivatives of antigen binding proteins can be prepared using techniques well known in the art. Certain antigen binding proteins include a pegylated single chain polypeptide as described herein. In one embodiment, the antigen binding protein is conjugated or otherwise linked to transthyretin (TTR) or a TTR variant. The TTR or TTR variant can be chemically modified with, for example, a chemical selected from the group consisting of dextran, poly(n-vinyl pyrrolidone), polyethylene glycols, propropylene glycol homopolymers, polypropylene oxide/ethylene oxide co-polymers, polyoxyethylated polyols and polyvinyl alcohols.

Other derivatives include covalent or aggregative conjugates of GIPR antigen binding proteins with other proteins or polypeptides, such as by expression of recombinant fusion proteins comprising heterologous polypeptides fused to the N-terminus or C-terminus of an GIPR antigen binding protein. For example, the conjugated peptide may be a heterologous signal (or leader) polypeptide, e.g., the yeast alpha-factor leader, or a peptide such as an epitope tag. GIPR antigen binding protein-containing fusion proteins can comprise peptides added to facilitate purification or identification of the GIPR antigen binding protein (e.g., poly-His). A GIPR antigen binding protein also can be linked to the FLAG peptide as described in Hopp et al., 1988, *Bio/Technology* 6:1204; and U.S. Pat. No. 5,011,912. The FLAG peptide is highly antigenic and provides an epitope reversibly bound by a specific monoclonal antibody (mAb), enabling rapid assay and facile purification of expressed recombinant protein. Reagents useful for preparing fusion proteins in which the FLAG peptide is fused to a given polypeptide are commercially available (Sigma, St. Louis, MO).

In some embodiments, the antigen binding protein comprises one or more labels. The term "labeling group" or "label" means any detectable label. Examples of suitable labeling groups include, but are not limited to, the following: radioisotopes or radionuclides (e.g., $^{3}H$, $^{14}C$, $^{15}N$, $^{35}S$, $^{90}Y$, $^{99}Tc$, $^{111}In$, $^{125}I$ $^{131}I$), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labeling group is coupled to the antigen binding protein via spacer arms of various lengths to reduce potential steric hindrance. Various methods for labeling proteins are known in the art and may be used as is seen fit.

The term "effector group" means any group coupled to an antigen binding protein that acts as a cytotoxic agent. Examples for suitable effector groups are radioisotopes or radionuclides (e.g., $^{3}H$, $^{14}C$, $^{15}N$, $^{35}S$, $^{90}Y$, $^{99}Tc$, $^{111}In$, $^{125}I$, $^{131}I$). Other suitable groups include toxins, therapeutic groups, or chemotherapeutic groups. Examples of suitable groups include calicheamicin, auristatins, geldanamycin and maytansine. In some embodiments, the effector group is coupled to the antigen binding protein via spacer arms of various lengths to reduce potential steric hindrance.

In general, labels fall into a variety of classes, depending on the assay in which they are to be detected: a) isotopic labels, which may be radioactive or heavy isotopes; b) magnetic labels (e.g., magnetic particles); c) redox active moieties; d) optical dyes; enzymatic groups (e.g. horseradish peroxidase, β-galactosidase, luciferase, alkaline phosphatase); e) biotinylated groups; and f) predetermined polypeptide epitopes recognized by a secondary reporter (e.g., leucine zipper pair sequences, binding sites for secondary antibodies, metal binding domains, epitope tags, etc.). In some embodiments, the labeling group is coupled to the antigen binding protein via spacer arms of various lengths to reduce potential steric hindrance. Various methods for labeling proteins are known in the art.

Specific labels include optical dyes, including, but not limited to, chromophores, phosphors and fluorophores, with the latter being specific in many instances. Fluorophores can be either "small molecule" fluores, or proteinaceous fluores.

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, OR), FITC, Rhodamine, and Texas Red (Pierce, Rockford, IL), Cy5, Cy5.5, Cy7 (Amersham Life Science, Pittsburgh, PA). Suitable optical dyes, including fluorophores, are described in Molecular Probes Handbook by Richard P. Haugland, hereby expressly incorporated by reference.

Suitable proteinaceous fluorescent labels also include, but are not limited to, green fluorescent protein, including a *Renilla, Ptilosarcus*, or *Aequorea* species of GFP (Chalfie et al., 1994, *Science* 263:802-805), EGFP (Clontech Labs., Inc., Genbank Accession Number U55762), blue fluorescent protein (BFP, Quantum Biotechnologies, Inc., Quebec, Canada; Stauber, 1998, *Biotechniques* 24:462-471; Heim et al., 1996, *Curr. Biol.* 6:178-182), enhanced yellow fluorescent protein (EYFP, Clontech Labs., Inc.), luciferase (Ichiki et al., 1993, *J. Immunol.* 150:5408-5417), β galactosidase (Nolan et al., 1988, *Proc. Natl. Acad. Sci. U.S.A.* 85:2603-2607) and *Renilla* (WO92/15673, WO95/07463, WO98/14605, WO98/26277, WO99/49019, U.S. Pat. Nos. 5,292,658, 5,418,155, 5,683,888, 5,741,668, 5,777,079, 5,804,387, 5,874,304, 5,876,995, 5,925,558).

Nucleic acids that encode for the antigen binding proteins described herein, or portions thereof, are also provided, including nucleic acids encoding one or both chains of an antibody, or a fragment, derivative, mutein, or variant thereof, polynucleotides encoding heavy chain variable regions or only CDRs, polynucleotides sufficient for use as hybridization probes, PCR primers or sequencing primers for identifying, analyzing, mutating or amplifying a polynucleotide encoding a polypeptide, anti-sense nucleic acids for inhibiting expression of a polynucleotide, and complementary sequences of the foregoing. The nucleic acids can be any length. They can be, for example, 5, 10, 15, 20, 25, 30, 35, 40, 45, 50, 75, 100, 125, 150, 175, 200, 250, 300, 350, 400, 450, 500, 750, 1,000, 1,500, 3,000, 5,000 or more nucleotides in length, and/or can comprise one or more additional sequences, for example, regulatory sequences, and/or be part of a larger nucleic acid, for example, a vector. The nucleic acids can be single-stranded or double-stranded and can comprise RNA and/or DNA nucleotides, and artificial variants thereof (e.g., peptide nucleic acids). Any variable region provided herein may be attached to these constant regions to form complete heavy and light chain sequences. However, it should be understood that these constant regions sequences are provided as specific examples only. In some embodiments, the variable region sequences are joined to other constant region sequences that are known in the art.

Nucleic acids encoding certain antigen binding proteins, or portions thereof (e.g., full length antibody, heavy or light chain, variable domain, or CDRH1, CDRH2, CDRH3, CDRL1, CDRL2, or CDRL3) may be isolated from B-cells of mice that have been immunized with GIPR or an immunogenic fragment thereof. The nucleic acid may be isolated by conventional procedures such as polymerase chain reaction (PCR). Phage display is another example of a known technique whereby derivatives of antibodies and other antigen binding proteins may be prepared. In one approach, polypeptides that are components of an antigen binding protein of interest are expressed in any suitable recombinant expression system, and the expressed polypeptides are allowed to assemble to form antigen binding proteins.

An aspect further provides nucleic acids that hybridize to other nucleic acids under particular hybridization conditions. Methods for hybridizing nucleic acids are well-known in the art. See, e.g., Current Protocols in Molecular Biology, John Wiley & Sons, N.Y. (1989), 6.3.1-6.3.6. As defined herein, a moderately stringent hybridization condition uses a prewashing solution containing 5× sodium chloride/sodium citrate (SSC), 0.5% SDS, 1.0 mM EDTA (pH 8.0), hybridization buffer of about 50% formamide, 6×SSC, and a hybridization temperature of 55° C. (or other similar hybridization solutions, such as one containing about 50% formamide, with a hybridization temperature of 42° C.), and washing conditions of 60° C., in 0.5×SSC, 0.1% SDS. A stringent hybridization condition hybridizes in 6×SSC at 45° C., followed by one or more washes in 0.1×SSC, 0.2% SDS at 68° C. Furthermore, one of skill in the art can manipulate the hybridization and/or washing conditions to increase or decrease the stringency of hybridization such that nucleic acids comprising nucleotide sequences that are at least 65%, 70%, 75%, 80%, 85%, 90%, 95%, 98% or 99% identical to each other typically remain hybridized to each other.

The basic parameters affecting the choice of hybridization conditions and guidance for devising suitable conditions are set forth by, for example, Sambrook, Fritsch, and Maniatis (2001, Molecular Cloning: A Laboratory Manual, Cold Spring Harbor Laboratory Press, Cold Spring Harbor, N.Y., supra; and Current Protocols in Molecular Biology, 1995, Ausubel et al., eds., John Wiley & Sons, Inc., sections 2.10 and 6.3-6.4), and can be readily determined by those having ordinary skill in the art based on, e.g., the length and/or base composition of the nucleic acid.

Changes can be introduced by mutation into a nucleic acid, thereby leading to changes in the amino acid sequence of a polypeptide (e.g., an antibody or antibody derivative) that it encodes. Mutations can be introduced using any technique known in the art. In one embodiment, one or more particular amino acid residues are changed using, for example, a site-directed mutagenesis protocol. In another embodiment, one or more randomly selected residues is changed using, for example, a random mutagenesis protocol. However it is made, a mutant polypeptide can be expressed and screened for a desired property.

Mutations can be introduced into a nucleic acid without significantly altering the biological activity of a polypeptide that it encodes. For example, one can make nucleotide substitutions leading to amino acid substitutions at non-essential amino acid residues. Alternatively, one or more mutations can be introduced into a nucleic acid that selectively changes the biological activity of a polypeptide that it encodes. For example, the mutation can quantitatively or qualitatively change the biological activity. Examples of quantitative changes include increasing, reducing or eliminating the activity. Examples of qualitative changes include changing the antigen specificity of an antibody. In one embodiment, a nucleic acid encoding any antigen binding protein described herein can be mutated to alter the amino acid sequence using molecular biology techniques that are well-established in the art.

Another aspect provides nucleic acid molecules that are suitable for use as primers or hybridization probes for the detection of nucleic acid sequences. A nucleic acid molecule can comprise only a portion of a nucleic acid sequence encoding a full-length polypeptide, for example, a fragment that can be used as a probe or primer or a fragment encoding an active portion of a polypeptide.

Probes based on the sequence of a nucleic acid can be used to detect the nucleic acid or similar nucleic acids, for example, transcripts encoding a polypeptide. The probe can comprise a label group, e.g., a radioisotope, a fluorescent compound, an enzyme, or an enzyme co-factor. Such probes can be used to identify a cell that expresses the polypeptide.

Another aspect provides vectors comprising a nucleic acid encoding a polypeptide or a portion thereof (e.g., a fragment containing one or more CDRs or one or more variable region domains). Examples of vectors include, but are not limited to, plasmids, viral vectors, non-episomal mammalian vectors and expression vectors, for example, recombinant expression vectors. The recombinant expression vectors can comprise a nucleic acid in a form suitable for expression of the nucleic acid in a host cell. The recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells (e.g., SV40 early gene enhancer, Rous sarcoma virus promoter and cytomegalovirus promoter), those that direct expression of the nucleotide sequence only in certain host cells (e.g., tissue-specific regulatory sequences, see, Voss et al., 1986, *Trends Biochem. Sci.* 11:287, Maniatis et al., 1987, *Science* 236:1237, incorporated by reference herein in their entireties), and those that direct inducible expression of a nucleotide sequence in response to particular treatment or condition (e.g., the metallothionin promoter in mammalian cells and the tet-responsive and/or streptomycin responsive promoter in both prokaryotic and eukaryotic systems (see, id.). It will be appreciated by those skilled in the art that the design of the expression vector can depend on such factors as the choice of the host cell to be transformed, the level of expression of protein desired, etc. The expression vectors can be introduced into host cells to thereby produce proteins or peptides, including fusion proteins or peptides, encoded by nucleic acids as described herein.

Another aspect provides host cells into which a recombinant expression vector has been introduced. A host cell can be any prokaryotic cell (for example, *E. coli*) or eukaryotic cell (for example, yeast, insect, or mammalian cells (e.g., CHO cells)). Vector DNA can be introduced into prokaryotic or eukaryotic cells via conventional transformation or transfection techniques. For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die), among other methods.

Expression systems and constructs in the form of plasmids, expression vectors, transcription or expression cassettes that comprise at least one polynucleotide as described above are also provided herein, as well host cells comprising such expression systems or constructs.

The antigen binding proteins provided herein may be prepared by any of a number of conventional techniques. For example, GIPR antigen binding proteins may be produced by recombinant expression systems, using any technique known in the art. See, e.g., Monoclonal Antibodies, Hybridomas: A New Dimension in Biological Analyses, Kennet et al. (eds.) Plenum Press, New York (1980); and Antibodies: A Laboratory Manual, Harlow and Lane (eds.), Cold Spring Harbor Laboratory Press, Cold Spring Harbor, N.Y. (1988).

Antigen binding proteins can be expressed in hybridoma cell lines (e.g., in particular antibodies may be expressed in hybridomas) or in cell lines other than hybridomas. Expression constructs encoding the antibodies can be used to transform a mammalian, insect or microbial host cell. Transformation can be performed using any known method for introducing polynucleotides into a host cell, including, for example packaging the polynucleotide in a virus or bacteriophage and transducing a host cell with the construct by transfection procedures known in the art, as exemplified by U.S. Pat. Nos. 4,399,216; 4,912,040; 4,740,461; 4,959,455. The optimal transformation procedure used will depend upon which type of host cell is being transformed. Methods for introduction of heterologous polynucleotides into mammalian cells are well known in the art and include, but are not limited to, dextran-mediated transfection, calcium phosphate precipitation, polybrene mediated transfection, protoplast fusion, electroporation, encapsulation of the polynucleotide(s) in liposomes, mixing nucleic acid with positively-charged lipids, and direct microinjection of the DNA into nuclei.

Recombinant expression constructs typically comprise a nucleic acid molecule encoding a polypeptide comprising one or more of the following: one or more CDRs provided herein; a light chain constant region; a light chain variable region; a heavy chain constant region (e.g., $C_H1$, $C_H2$ and/or $C_H3$); and/or another scaffold portion of a GIPR antigen binding protein. These nucleic acid sequences are inserted into an appropriate expression vector using standard ligation techniques. In one embodiment, the heavy or light chain constant region is appended to the C-terminus of the anti-GIPR specific heavy or light chain variable region and is ligated into an expression vector. The vector is typically selected to be functional in the particular host cell employed (i.e., the vector is compatible with the host cell machinery, permitting amplification and/or expression of the gene can occur). In some embodiments, vectors are used that employ protein-fragment complementation assays using protein reporters, such as dihydrofolate reductase (see, for example, U.S. Pat. No. 6,270,964, which is hereby incorporated by reference). Suitable expression vectors can be purchased, for example, from Invitrogen Life Technologies or BD Biosciences (formerly "Clontech"). Other useful vectors for cloning and expressing the antibodies and fragments include those described in Bianchi and McGrew, 2003, *Biotech. Biotechnol. Bioeng.* 84:439-44, which is hereby incorporated by reference. Additional suitable expression vectors are discussed, for example, in *Methods Enzymol.*, vol. 185 (D. V. Goeddel, ed.), 1990, New York: Academic Press.

Typically, expression vectors used in any of the host cells will contain sequences for plasmid maintenance and for cloning and expression of exogenous nucleotide sequences. Such sequences, collectively referred to as "flanking sequences" in certain embodiments will typically include one or more of the following nucleotide sequences: a promoter, one or more enhancer sequences, an origin of replication, a transcriptional termination sequence, a complete intron sequence containing a donor and acceptor splice site, a sequence encoding a leader sequence for polypeptide secretion, a ribosome binding site, a polyadenylation sequence, a polylinker region for inserting the nucleic acid encoding the polypeptide to be expressed, and a selectable marker element. Each of these sequences is discussed below.

Optionally, the vector may contain a "tag"-encoding sequence, i.e., an oligonucleotide molecule located at the 5' or 3' end of the GIPR antigen binding protein coding sequence; the oligonucleotide sequence encodes polyHis (such as hexaHis), or another "tag" such as FLAG®, HA (hemaglutinin influenza virus), or myc, for which commercially available antibodies exist. This tag is typically fused to the polypeptide upon expression of the polypeptide, and can serve as a means for affinity purification or detection of the GIPR antigen binding protein from the host cell. Affinity purification can be accomplished, for example, by column chromatography using antibodies against the tag as an affinity matrix. Optionally, the tag can subsequently be removed from the purified GIPR antigen binding protein by various means such as using certain peptidases for cleavage.

Flanking sequences may be homologous (i.e., from the same species and/or strain as the host cell), heterologous (i.e., from a species other than the host cell species or strain), hybrid (i.e., a combination of flanking sequences from more than one source), synthetic or native. As such, the source of a flanking sequence may be any prokaryotic or eukaryotic organism, any vertebrate or invertebrate organism, or any plant, provided that the flanking sequence is functional in, and can be activated by, the host cell machinery.

Flanking sequences useful in the vectors may be obtained by any of several methods well known in the art. Typically, flanking sequences useful herein will have been previously identified by mapping and/or by restriction endonuclease digestion and can thus be isolated from the proper tissue source using the appropriate restriction endonucleases. In some cases, the full nucleotide sequence of a flanking sequence may be known. Here, the flanking sequence may be synthesized using the methods described herein for nucleic acid synthesis or cloning.

Whether all or only a portion of the flanking sequence is known, it may be obtained using polymerase chain reaction (PCR) and/or by screening a genomic library with a suitable probe such as an oligonucleotide and/or flanking sequence fragment from the same or another species. Where the flanking sequence is not known, a fragment of DNA containing a flanking sequence may be isolated from a larger piece of DNA that may contain, for example, a coding sequence or even another gene or genes. Isolation may be accomplished by restriction endonuclease digestion to produce the proper DNA fragment followed by isolation using agarose gel purification, Qiagen® column chromatography (Chatsworth, CA), or other methods known to the skilled artisan. The selection of suitable enzymes to accomplish this purpose will be readily apparent to one of ordinary skill in the art.

An origin of replication is typically a part of those prokaryotic expression vectors purchased commercially, and the origin aids in the amplification of the vector in a host cell. If the vector of choice does not contain an origin of replication site, one may be chemically synthesized based on a known sequence, and ligated into the vector. For example, the origin of replication from the plasmid pBR322 (New England Biolabs, Beverly, MA) is suitable for most gram-negative bacteria, and various viral origins (e.g., SV40, polyoma, adenovirus, vesicular stomatitus virus (VSV), or papillomaviruses such as HPV or BPV) are useful for cloning vectors in mammalian cells. Generally, the origin of replication component is not needed for mammalian expression vectors (for example, the SV40 origin is often used only because it also contains the virus early promoter).

A transcription termination sequence is typically located 3' to the end of a polypeptide coding region and serves to terminate transcription. Usually, a transcription termination sequence in prokaryotic cells is a G-C rich fragment followed by a poly-T sequence. While the sequence is easily cloned from a library or even purchased commercially as part of a vector, it can also be readily synthesized using methods for nucleic acid synthesis such as those described herein.

A selectable marker gene encodes a protein necessary for the survival and growth of a host cell grown in a selective culture medium. Typical selection marker genes encode proteins that (a) confer resistance to antibiotics or other toxins, e.g., ampicillin, tetracycline, or kanamycin for prokaryotic host cells; (b) complement auxotrophic deficiencies of the cell; or (c) supply critical nutrients not available from complex or defined media. Specific selectable markers are the kanamycin resistance gene, the ampicillin resistance gene, and the tetracycline resistance gene. Advantageously, a neomycin resistance gene may also be used for selection in both prokaryotic and eukaryotic host cells.

Other selectable genes may be used to amplify the gene that will be expressed. Amplification is the process wherein genes that are required for production of a protein critical for growth or cell survival are reiterated in tandem within the chromosomes of successive generations of recombinant cells. Examples of suitable selectable markers for mammalian cells include dihydrofolate reductase (DHFR) and promoterless thymidine kinase genes. Mammalian cell transformants are placed under selection pressure wherein only the transformants are uniquely adapted to survive by virtue of the selectable gene present in the vector. Selection pressure is imposed by culturing the transformed cells under conditions in which the concentration of selection agent in the medium is successively increased, thereby leading to the amplification of both the selectable gene and the DNA that encodes another gene, such as an antigen binding protein that binds GIPR polypeptide. As a result, increased quantities of a polypeptide such as an antigen binding protein are synthesized from the amplified DNA.

A ribosome-binding site is usually necessary for translation initiation of mRNA and is characterized by a Shine-Dalgarno sequence (prokaryotes) or a Kozak sequence (eukaryotes). The element is typically located 3' to the promoter and 5' to the coding sequence of the polypeptide to be expressed.

In some cases, such as where glycosylation is desired in a eukaryotic host cell expression system, one may manipulate the various pre- or pro-sequences to improve glycosylation or yield. For example, one may alter the peptidase cleavage site of a particular signal peptide, or add prosequences, which also may affect glycosylation. The final protein product may have, in the −1 position (relative to the first amino acid of the mature protein), one or more additional amino acids incident to expression, which may not have been totally removed. For example, the final protein product may have one or two amino acid residues found in the peptidase cleavage site, attached to the amino-terminus. Alternatively, use of some enzyme cleavage sites may result in a slightly truncated form of the desired polypeptide, if the enzyme cuts at such area within the mature polypeptide.

Expression and cloning will typically contain a promoter that is recognized by the host organism and operably linked to the molecule encoding the GIPR antigen binding protein. Promoters are untranscribed sequences located upstream (i.e., 5') to the start codon of a structural gene (generally within about 100 to 1000 bp) that control transcription of the structural gene. Promoters are conventionally grouped into one of two classes: inducible promoters and constitutive promoters. Inducible promoters initiate increased levels of transcription from DNA under their control in response to some change in culture conditions, such as the presence or absence of a nutrient or a change in temperature. Constitutive promoters, on the other hand, uniformly transcribe a gene to which they are operably linked, that is, with little or no control over gene expression. A large number of promoters, recognized by a variety of potential host cells, are well known. A suitable promoter is operably linked to the DNA encoding heavy chain or light chain comprising a GIPR antigen binding protein by removing the promoter from the source DNA by restriction enzyme digestion and inserting the desired promoter sequence into the vector.

Suitable promoters for use with yeast hosts are also well known in the art. Yeast enhancers are advantageously used with yeast promoters. Suitable promoters for use with mammalian host cells are well known and include, but are not limited to, those obtained from the genomes of viruses such as polyoma virus, fowlpox virus, adenovirus (such as Adenovirus 2), bovine papilloma virus, avian sarcoma virus, cytomegalovirus, retroviruses, hepatitis-B virus, and Simian Virus 40 (SV40). Other suitable mammalian promoters include heterologous mammalian promoters, for example, heat-shock promoters and the actin promoter.

An enhancer sequence may be inserted into the vector to increase transcription of DNA encoding light chain or heavy chain comprising a GIPR antigen binding protein by higher eukaryotes. Enhancers are cis-acting elements of DNA, usually about 10-300 bp in length, that act on the promoter to increase transcription. Enhancers are relatively orientation and position independent, having been found at positions both 5' and 3' to the transcription unit. Several enhancer sequences available from mammalian genes are known (e.g., globin, elastase, albumin, alpha-feto-protein and insulin). Typically, however, an enhancer from a virus is used. The SV40 enhancer, the cytomegalovirus early promoter enhancer, the polyoma enhancer, and adenovirus enhancers known in the art are exemplary enhancing elements for the activation of eukaryotic promoters. While an enhancer may be positioned in the vector either 5' or 3' to a coding sequence, it is typically located at a site 5' from the promoter. A sequence encoding an appropriate native or heterologous signal sequence (leader sequence or signal peptide) can be incorporated into an expression vector, to promote extracellular secretion of the antibody. The choice of signal peptide or leader depends on the type of host cells in which the antibody is to be produced, and a heterologous signal sequence can replace the native signal sequence. Examples of signal peptides that are functional in mammalian host cells include the following: the signal sequence for interleukin-7 (IL-7) described in U.S. Pat. No. 4,965,195; the signal sequence for interleukin-2 receptor described in Cosman et al., 1984, *Nature* 312:768; the interleukin-4 receptor signal peptide described in EP Patent No. 0367 566; the type I interleukin-1 receptor signal peptide described in U.S. Pat. No. 4,968,607; the type II interleukin-1 receptor signal peptide described in EP Patent No. 0 460 846.

In one embodiment the leader sequence comprises SEQ ID NO: 1217 (MDMRVPAQLL GLLLLWLRGA RC) which is encoded by SEQ ID NO: 1218 (atggacatga gagtgcctgc acagctgctg ggcctgctgc tgctgtggct gagaggcgcc agatgc).

In another embodiment the leader sequence comprises SEQ ID NO: 1219 (MAWALLLLTL LTQGTGSWA) which is encoded by SEQ ID NO: 1220 (atggcctggg ctctgctgct cctcaccctc ctcactcagg gcacagggtc ctgggcc).

The expression vectors that are provided may be constructed from a starting vector such as a commercially available vector. Such vectors may or may not contain all of the desired flanking sequences. Where one or more of the flanking sequences described herein are not already present in the vector, they may be individually obtained and ligated into the vector. Methods used for obtaining each of the flanking sequences are well known to one skilled in the art.

After the vector has been constructed and a nucleic acid molecule encoding light chain, a heavy chain, or a light chain and a heavy chain comprising a GIPR antigen binding sequence has been inserted into the proper site of the vector, the completed vector may be inserted into a suitable host cell for amplification and/or polypeptide expression. The transformation of an expression vector for an antigen-binding protein into a selected host cell may be accomplished by well-known methods including transfection, infection, calcium phosphate co-precipitation, electroporation, microinjection, lipofection, DEAE-dextran mediated transfection, or other known techniques. The method selected will in part be a function of the type of host cell to be used. These methods and other suitable methods are well known to the skilled artisan, and are set forth, for example, in Sambrook et al., 2001, supra.

A host cell, when cultured under appropriate conditions, synthesizes an antigen binding protein that can subsequently be collected from the culture medium (if the host cell secretes it into the medium) or directly from the host cell producing it (if it is not secreted). The selection of an appropriate host cell will depend upon various factors, such as desired expression levels, polypeptide modifications that are desirable or necessary for activity (such as glycosylation or phosphorylation) and ease of folding into a biologically active molecule.

Mammalian cell lines available as hosts for expression are well known in the art and include, but are not limited to, immortalized cell lines available from the American Type Culture Collection (ATCC), including but not limited to Chinese hamster ovary (CHO) cells, HeLa cells, baby hamster kidney (BHK) cells, monkey kidney cells (COS), human hepatocellular carcinoma cells (e.g., Hep G2), and a number of other cell lines. In certain embodiments, cell lines may be selected through determining which cell lines have high expression levels and constitutively produce antigen binding proteins with GIPR binding properties. In another embodiment, a cell line from the B cell lineage that does not make its own antibody but has a capacity to make and secrete a heterologous antibody can be selected.

In one embodiment, the present invention is directed to an antigen binding protein produced by a cell expressing one or more of the polynucleotides identified in Tables 2, 3, 4, and 5.

In one aspect, a GIPR binding protein is administered for chronic treatment. In another aspect, the binding proteins are administered for acute therapy.

Pharmaceutical compositions that comprise a GIPR antigen binding protein are also provided and can be utilized in any of the preventive and therapeutic methods disclosed herein. In an embodiment, a therapeutically effective amount of one or a plurality of the antigen binding proteins and a pharmaceutically acceptable diluent, carrier, solubilizer, emulsifier, preservative, and/or adjuvant are also provided. Acceptable formulation materials are nontoxic to recipients at the dosages and concentrations employed.

In certain embodiments, the pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. REMINGTON'S PHARMACEUTICAL SCIENCES, 18" Edition, (A. R. Genrmo, ed.), 1990, Mack Publishing Company provides additional details and options for suitable agents that can be incorporated into the pharmaceutical compositions.

In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antigen binding proteins disclosed. In certain embodiments, the primary vehicle or carrier in a pharmaceutical composition may be either aqueous or non-aqueous in nature. For example, a suitable vehicle or carrier may be water for injection or physiological saline solution. In certain embodiments, GIPR antigen binding protein compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the GIPR antigen binding protein may be formulated as a lyophilizate using appropriate excipients such as sucrose.

The pharmaceutical compositions can be selected for parenteral delivery. Alternatively, the compositions may be selected for inhalation or for delivery through the digestive tract, such as orally. Preparation of such pharmaceutically acceptable compositions is within the skill of the art.

The formulation components are present preferably in concentrations that are acceptable to the site of administration. In certain embodiments, buffers are used to maintain the composition at physiological pH or at a slightly lower pH, typically within a pH range of from about 5 to about 8.

When parenteral administration is contemplated, the therapeutic compositions may be provided in the form of a pyrogen-free, parenterally acceptable aqueous solution comprising the desired human GIPR antigen binding protein in a pharmaceutically acceptable vehicle. A particularly suitable vehicle for parenteral injection is sterile distilled water in which the GIPR antigen binding protein is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antigen binding protein.

Certain pharmaceutical compositions are formulated for inhalation. In some embodiments, GIPR antigen binding proteins are formulated as a dry, inhalable powder. In specific embodiments, GIPR antigen binding protein inhalation solutions may also be formulated with a propellant for aerosol delivery. In certain embodiments, solutions may be nebulized. Pulmonary administration and formulation methods therefore are further described in International Patent Application No. PCT/US94/001875, which is incorporated by reference and describes pulmonary delivery of chemically modified proteins. Some formulations can be administered orally. GIPR antigen binding proteins that are administered in this fashion can be formulated with or without carriers customarily used in the compounding of solid dosage forms such as tablets and capsules. In certain embodiments, a capsule may be designed to release the active portion of the formulation at the point in the gastrointestinal tract when bioavailability is maximized and pre-systemic degradation is minimized. Additional agents can be included to facilitate absorption of the GIPR antigen binding protein. Diluents, flavorings, low melting point waxes, vegetable oils, lubricants, suspending agents, tablet disintegrating agents, and binders may also be employed.

Some pharmaceutical compositions comprise an effective quantity of one or a plurality of GIPR antigen binding proteins in a mixture with non-toxic excipients that are suitable for the manufacture of tablets. By dissolving the tablets in sterile water, or another appropriate vehicle, solutions may be prepared in unit-dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions will be evident to those skilled in the art, including formulations involving GIPR binding proteins in sustained- or controlled-delivery formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which is incorporated by reference and describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481, each of which is incorporated by reference), copolymers of L-glutamic acid and gamma ethyl-L-glutamate (Sidman et al., 1983, *Biopolymers* 2:547-556), poly (2-hydroxyethyl-inethacrylate) (Langer et al., 1981, *J. Biomed. Mater. Res.* 15:167-277 and Langer, 1982, *Chem. Tech.* 12:98-105), ethylene vinyl acetate (Langer et al., 1981, supra) or poly-D(−)-3-hydroxybutyric acid (European Patent Application Publication No. EP 133,988). Sustained release compositions may also include liposomes that can be prepared by any of several methods known in the art. See, e.g., Eppstein et al., 1985, *Proc. Natl. Acad. Sci. U.S.A.* 82:3688-3692; European Patent Application Publication Nos. EP 036,676; EP 088,046 and EP 143,949, incorporated by reference.

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

In certain formulations, an antigen binding protein has a concentration of at least 10 mg/mL, 20 mg/mL, 30 mg/mL, 40 mg/mL, 50 mg/mL, 60 mg/mL, 70 mg/mL, 80 mg/mL, 90 mg/mL, 100 mg/mL or 150 mg/mL. In one embodiment, a pharmaceutical composition comprises the antigen binding protein, a buffer and polysorbate. In other embodiments, the pharmaceutical composition comprises an antigen binding protein, a buffer, sucrose and polysorbate. An example of a pharmaceutical composition is one containing 50-100 mg/mL of antigen binding protein, 5-20 mM sodium acetate, 5-10% w/v sucrose, and 0.002-0.008% w/v polysorbate. Certain, compositions, for instance, contain 65-75 mg/mL of an antigen binding protein in 9-11 mM sodium acetate buffer, 8-10% w/v sucrose, and 0.005-0.006% w/v polysorbate. The pH of certain such formulations is in the range of 4.5-6. Other formulations have a pH of 5.0-5.5 (e.g., pH of 5.0, 5.2 or 5.4).

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration. Kits for producing a single-dose administration unit are also provided. Certain kits contain a first container having a dried protein and a second container having an aqueous formulation. In certain embodiments, kits containing single and multi-chambered pre-filled syringes (e.g., liquid syringes and lyosyringes) are provided. The therapeutically effective amount of a GIPR antigen binding protein-containing pharmaceutical composition to be employed will depend, for example, upon the therapeutic context and objectives. One skilled in the art will appreciate that the appropriate dosage levels for treatment will vary depending, in part, upon the molecule delivered, the indication for which the GIPR antigen binding protein is being used, the route of administration, and the size (body weight, body surface or organ size) and/or condition (the age and general health) of the patient. In certain embodiments, the clinician may titer the dosage and modify the route of administration to obtain the optimal therapeutic effect.

Dosing frequency will depend upon the pharmacokinetic parameters of the particular GIPR antigen binding protein in the formulation used. Typically, a clinician administers the composition until a dosage is reached that achieves the desired effect. The composition may therefore be administered as a single dose, or as two or more doses (which may or may not contain the same amount of the desired molecule) over time, or as a continuous infusion via an implantation device or catheter. Appropriate dosages may be ascertained through use of appropriate dose-response data. In certain embodiments, the antigen binding proteins can be administered to patients throughout an extended time period. In certain embodiments, the antigen binding protein is dosed every two weeks, every month, every two months, every three months, every four months, every five months, or every six months.

The route of administration of the pharmaceutical composition is in accord with known methods, e.g., orally, through injection by intravenous, intraperitoneal, intracerebral (intra-parenchymal), intracerebroventricular, intramuscular, intra-ocular, intraarterial, intraportal, or intralesional routes; by sustained release systems or by implantation devices. In certain embodiments, the compositions may be administered by bolus injection or continuously by infusion, or by implantation device.

The composition also may be administered locally via implantation of a membrane, sponge or another appropriate material onto which the desired molecule has been absorbed or encapsulated. In certain embodiments, where an implantation device is used, the device may be implanted into any suitable tissue or organ, and delivery of the desired molecule may be via diffusion, timed-release bolus, or continuous administration.

It also may be desirable to use GIPR antigen binding protein pharmaceutical compositions according to the disclosed ex vivo. In such instances, cells, tissues or organs that have been removed from the patient are exposed to GIPR antigen binding protein pharmaceutical compositions after which the cells, tissues and/or organs are subsequently implanted back into the patient.

A physician will be able to select an appropriate treatment indication and target lipid levels depending on the individual profile of a particular patient. One well-accepted standard for guiding treatment of hyperlipidemia is the Third Report of the National Cholesterol Education Program (NCEP) Expert Panel on Detection, Evaluation, and Treatment of the High Blood Cholesterol in Adults (Adult Treatment Panel III) Final Report, National Institutes of Health, NIH Publication No. 02-5215 (2002), the printed publication of which is hereby incorporated by reference in its entirety.

The efficacy of a particular dose can be assessed by reference to biomarkers or improvement in certain physiological parameters. Examples of suitable biomarkers include, the ratio of free cholesterol to plasma lipid, free cholesterol to membrane protein, phospatidylcholine to sphingomyelin, or HDL-C levels.

Also provided herein are compositions comprising a GIPR antigen binding protein and one or more additional therapeutic agents, as well as methods in which such agents are administered concurrently or sequentially with a GIPR antigen binding protein for use in the preventive and therapeutic methods disclosed herein. The one or more additional agents can be co-formulated with a GIPR antigen binding protein or can be co-administered with a GIPR antigen binding protein. In general, the therapeutic methods, compositions and compounds may also be employed in combination with other therapeutics in the treatment of various disease states, with the additional agents being administered concurrently.

In one aspect the present invention is directed to a method of treating a subject with a metabolic disorder, the method comprising administering to the subject a therapeutically effective amount of a GLP-1 receptor agonist and a therapeutically effective amount of a GIPR antagonist that specifically binds to a protein having an amino acid sequence having at least 90% amino acid sequence identity to an amino acid sequence of a GIPR.

A “GLP-1 receptor agonist” refers to compounds having GLP-1 receptor activity. Such exemplary compounds include exendins, exendin analogs, exendin agonists, GLP-1(7-37), GLP-1(7-37) analogs, GLP-1(7-37) agonists, and the like. The GLP-1 receptor agonist compounds may optionally be amidated. The terms “GLP-1 receptor agonist” and “GLP-1 receptor agonist compound” have the same meaning.

The term “exendin” includes naturally occurring (or synthetic versions of naturally occurring) exendin peptides that are found in the salivary secretions of the Gila monster. Exendins of particular interest include exendin-3 and exendin-4. The exendins, exendin analogs, and exendin agonists for use in the methods described herein may optionally be amidated, and may also be in an acid form, pharmaceutically acceptable salt form, or any other physiologically active form of the molecule.

In one embodiment, the molar ratio of a GLP-1 receptor agonist to a GIPR antagonist is from about 1:1 to 1:110, 1:1 to 1:100, 1:1 to 1:75, 1:1 to 1:50, 1:1 to 1:25, 1:1 to 1:10, 1:1 to 1:5, or 1:1. In one embodiment, the molar ratio of a GIPR antagonist to a GLP-1 receptor agonist is from about 1:1 to 1:110, 1:1 to 1:100, 1:1 to 1:75, 1:1 to 1:50, 1:1 to 1:25, 1:1 to 1:10, or 1:1 to 1:5.

In one embodiment, the GLP-1 receptor agonist is used in combination with the GIPR antagonist at therapeutically effective molar ratios of between about 1:1.5 to 1:150, preferably 1:2 to 1:50.

In one embodiment, the GLP-1 receptor agonist and the GIPR antagonist are present in doses that are at least about 1.1 to 1.4, 1.5, 2, 3, 4, 5, 6, 7, 8, 9, or 10 fold lower than the doses of each compound alone required to treat a condition and/or disease.

In one embodiment, the GLP-1 receptor agonist is GLP-1(7-37) or a GLP-1(7-37) analog.

In one embodiment, the GLP-1 receptor agonist is selected from the group consisting of exenatide, liraglutide, lixisenatide, albiglutide, dulaglutide, semaglutide, and taspoglutide.

In one aspect the present invention is directed to a method of treatment comprising administering to a subject a therapeutically effective amount of at least one GLP-1 receptor agonist in combination with administration of at least one GIPR antagonist which upon administration to a subject with symptoms of a metabolic disorder provides sustained beneficial effects.

In one embodiment, administration of at least one GLP-1 receptor agonist in combination with administration of at least one GIPR antagonist provides sustained beneficial effects of at least one symptom of a metabolic disorder.

In one embodiment, the therapeutically effective amounts of the GLP-1 receptor agonist and the GIPR antagonist are combined prior to administration to the subject.

In one embodiment, the therapeutically effective amounts of the GLP-1 receptor agonist and the GIPR antagonist are administered to the subject sequentially.

In one embodiment, the therapeutically effective amounts of a GLP-1 receptor agonist and a GIPR antagonist are synergistically effective amounts.

Exendin-4 (HGEGTFTSDLSKQMEEEAVRLFIEWLKNGGPSSGAPPPS-$NH_2$ (SEQ ID NO: 1223)) is a peptide found in the saliva of the Gila monster, Heloderma suspectum; and exendin-3 (HSDGTFTSDLSKQMEEEAVRLFIEWLKNGGPSSGAPPPS-$NH_2$(SEQ ID NO: 1224)) is a peptide found in the saliva of the beaded lizard, Heloderma horridum. Exendins have some amino acid sequence similarity to some members of the glucagon-like peptide (GLP) family. For example, exendin-4 has about 53% sequence identity with glucagon-like peptide-1(GLP-1)(7-37) (HAEGTFTSDVSSYLEGQAAKEFIAWLVKGRG (SEQ ID NO: 1244)). However, exendin-4 is transcribed from a distinct gene, not the Gila monster homolog of the mammalian proglucagon gene from which GLP-1 is expressed. Additionally, exendin-4 is not an analog of GLP-1(7-37) because the structure of synthetic exendin-4 peptide was not created by sequential modification of the structure of GLP-1. Nielsen et al., *Current Opinion in Investigational Drugs,* 4(4):401-405 (2003).

Synthetic exendin-4, also known as exenatide, is commercially available as BYETTA® (Amylin Pharmaceuticals, Inc. and Eli Lilly and Company). A once weekly formulation of exenatide is described in WO 2005/102293, the disclosure of which is incorporated by reference herein.

"Exendin analog" refers to peptides which elicit a biological activity of an exendin reference peptide, preferably having a potency equal to or better than the exendin reference peptide (e.g., exendin-4), or within five orders of magnitude (plus or minus) of potency compared to the exendin reference peptide, when evaluated by art-known measures such as receptor binding and/or competition studies as described, e.g., by Hargrove et al., *Regulatory Peptides,* 141:113-119 (2007), the disclosure of which is incorporated by reference herein. Preferably, the exendin analogs will bind in such assays with an affinity of less than 1 μM, and more preferably with an affinity of less than 3 nM, less than 1 nM, or less than 0.1 nM. The term "exendin analog" may also be referred to as "exendin agonist". In a preferred embodiment, the exendin analog is an exendin-4 analog.

Exendin analogs also include the peptides described herein which have been chemically derivatized or altered, for example, peptides with non-natural amino acid residues (e.g., taurine, β-amino acid residues, γ-amino acid residues, and D-amino acid residues), C-terminal functional group modifications, such as amides, esters, and C-terminal ketone modifications and N-terminal functional group modifications, such as acylated amines, Schiff bases, or cyclization, as found, for example, in the amino acid pyroglutamic acid. Exendin analogs may also contain other chemical moieties, such as peptide mimetics.

Exemplary exendins and exendin analogs exendin-4 (SEQ ID NO: 1223); exendin-3 (SEQ ID NO: 1224): $Leu^{14}$-exendin-4 (SEQ ID NO: 1225); $Leu^{14}$,$Phe^{25}$-exendin-4 (SEQ ID NO: 1226); $Leu^{14}$,$Ala^{19}$,$Phe^{25}$-exendin-4 (SEQ ID NO: 1227); exendin-4(1-30) (SEQ ID NO: 1228); $Leu^{14}$-exendin-4(1-30) (SEQ ID NO: 1229); $Leu^{14}$,$Phe^{25}$-exendin-4(1-30) (SEQ ID NO: 1230): $Leu^{14}$,$Ala^{19}$,$Phe^{25}$-exendin-4(1-30) (SEQ ID NO: 1231); exendin-4(1-28) (SEQ ID NO: 1232): $Leu^{14}$-exendin-4(1-28) (SEQ ID NO: 1233); $Leu^{14}$,$Phe^{25}$-exendin-4(1-28) (SEQ ID NO: 1234); $Leu^{14}$,$Ala^{19}$,$Phe^{25}$-exendin-4 (1-28) (SEQ ID NO: 1235); $Leu^{14}$,$Lys^{17,20}$,$Ala^{19}$,$Glu^{21}$,$Phe^{25}$,$Gln^{28}$-exendin-4 (SEQ ID NO; 1236); $Leu^{14}$,$Lys^{17,20}$,$Ala^{19}$,$Glu^{21}$,$Gln^{28}$-exendin-4 (SEQ ID NO: 1237): octylGly$^{14}$,$Gln^{28}$-exendin-4 (SEQ ID NO: 1238); $Leu^{14}$,$Gln^{28}$,octylGly$^{34}$-exendin-4 (SEQ ID NO: 1239); $Phe^{4}$,$Leu^{14}$,$Gln^{28}$,$Lys^{33}$,$Glu^{34}$, $Ile^{35,36}$,$Ser^{37}$-exendin-4(1-37) (SEQ ID NO: 1240); $Phe^{4}$,$Leu^{14}$,$Lys^{17,20}$,$Ala^{19}$,$Glu^{21}$,$Gln^{28}$-exendin-4 (SEQ ID NO: 1241): $Val^{11}$,$Ile^{13}$,$Leu^{14}$,$Ala^{16}$,$Lys^{21}$,$Phe^{25}$-exendin-4 (SEQ ID NO: 1242); exendin-4-$Lys^{40}$ (SEQ ID NO: 1243); lixisenatide (Sanofi-Aventis/Zealand Pharma); CJC-1134 (ConjuChem, Inc.); [$N^{e}$-(17-carboxyheptadecanoic acid)$Lys^{20}$]exendin-4-$NH_2$(SEQ ID NO: 1268); [$N^{e}$-(17-carboxyhepta-decanoyl)$Lys^{32}$]exendin-4-$NH_2$(SEQ ID NO: 1269); [desamino-$His^{1}$, $N^{e}$-(17-carboxyheptadecanoyl)$Lys^{20}$]exendin-4-$NH_2$(SEQ ID NO: 1270); [$Arg^{12,27}$,$NLe^{14}$,$N^{e}$-(17-carboxy-heptadecanoyl)$Lys^{32}$]exendin-4-$NH_2$(SEQ ID NO: 1271); [$N^{e}$-(19-carboxy-nonadecanolamino)$Lys^{20}$]-exendin-4-$NH_2$(SEQ ID NO: 1272); [$N^{e}$-(15-carboxypentadecanoylamino)$Lys^{20}$]-exendin-4-$NH_2$(SEQ ID NO: 1273); [$N^{e}$-(13-carboxytridecanoylamino)$Lys^{20}$]exendin-4-$NH_2$(SEQ ID NO: 1274); [$N^{e}$-(11-carboxy-undecanoyl-amino)$Lys^{20}$]exendin-4-$NH_2$ (SEQ ID NO: 1275): exendin-4-$Lys^{40}$(e-MPA)-$NH_2$ (SEQ ID NO: 1276); exendin-4-$Lys^{40}$(e-AEEA-AEEA-MPA)-$NH_2$(SEQ ID NO: 1277); exendin-4-$Lys^{40}$(e-AEEA-MPA)-$NH_2$(SEQ ID NO: 1278); exendin-4-$Lys^{40}$(e-MPA)-albumin (SEQ ID NO: 1279); exendin-4-$Lys^{40}$(e-AEEA-AEEA-MPA)-albumin (SEQ ID NO: 1280); exendin-4-$Lys^{40}$(e-AEEA-MPA)-albumin (SEQ ID NO: 1281): and the like. AEEA refers to [2-(2-amino)ethoxy)]acetic acid. EDA refers to ethylenediamine. MPA refers to maleimidopropionic acid. The exendins and exendin analogs may optionally be amidated.

In one embodiment, the GLP-1 receptor agonist compound is an exendin-4 analog that has at least 80% sequence identity to exendin-4 (SEQ ID NO: 1223); at least 85% sequence identity to exendin-4 (SEQ ID NO: 1223); at least 90% sequence identity to exendin-4 (SEQ ID NO: 1223); or at least 95% sequence identity to exendin-4 (SEQ ID NO: 1223).

Other exendins and exendin analogs useful in the methods described herein include those described in WO 98/05351; WO 99/07404; WO 99/25727; WO 99/25728; WO 99/40788; WO 00/41546; WO 00/41548; WO 00/73331; WO 01/51078; WO 03/099314; U.S. Pat. Nos. 6,956,026; 6,506,724; 6,703,359; 6,858,576; 6,872,700; 6,902,744; 7,157,555; 7,223,725; 7,220,721; US Publication No. 2003/

0036504; and US Publication No. 2006/0094652, the disclosures of which are incorporated by reference herein in their entirety.

"GLP-1(7-37) analogs" refers to peptides which elicit a biological activity similar to that of GLP-1(7-37), when evaluated by art-known measures such as receptor binding assays or in vivo blood glucose assays as described, e.g., by Hargrove et al., *Regulatory Peptides,* 141:113-119 (2007); the disclosure of which is incorporated by reference herein. In one embodiment; the term "GLP-1(7-37) analog" refers to a peptide that has an amino acid sequence with 1, 2, 3, 4, 5, 6, 7 or 8 amino acid substitutions, insertions, deletions, or a combination of two or more thereof, when compared to the amino acid sequence of GLP-1(7-37). In one embodiment, the GLP-1(7-37) analog is GLP-1(7-36)-$NH_2$, GLP-1(7-37) analogs include the amidated forms, the acid form, the pharmaceutically acceptable salt form, and any other physiologically active form of the molecule.

Exemplary GLP-1(7-37) and GLP-1(7-37) analogs include GLP-1(7-37) (SEQ ID NO: 1244); GLP-1(7-36)-$NH_2$ (SEQ ID NO: 1245); liraglutide (VICTOZA® from Novo Nordisk); albiglutide (SYNCRIA® from GlaxoSmithKline); taspoglutide (Hoffman La-Roche); dulaglutide (also known LY2189265; Eli Lilly and Company); LY2428757 (Eli Lilly and Company); desamino-$His^7$,$Arg^{26}$, $Lys^{34}$($N^\varepsilon$-(γ-Glu(N-α-hexadecanoyl)))-GLP-1(7-37) (core peptide disclosed as SEQ ID NO: 1282): desamino-$His^7$, $Arg^{26}$,$Lys^{34}$($N^\varepsilon$-octanoyl)-GLP-1(7-37) (SEQ ID NO: 1283); $Arg^{26,34}$,$Lys^{38}$($N^\varepsilon$-(ω-carboxypentadecanoyl))-GLP-1(7-38) (SEQ ID NO: 1284): $Arg^{26,34}$,$Lys^{36}$($N^\varepsilon$-(γ-Glu(N-α-hexadecanoyl)))-GLP-1(7-36) (core peptide disclosed as SEQ ID NO: 1285); $Aib^{8,35}$,$Arg^{26,34}$,$Phe^{31}$-GLP-1(7-36)) (SEQ ID NO: 1246); $HXaa_8EGTFTSDVSSYLEXaa_{22}Xaa_{23}AAKEFIXaa_{30}WLXaa_{33}Xaa_{34}G\ Xaa_{36}Xaa_{37}$; wherein $Xaa_3$ is A, V, or G; $Xaa_{22}$ is G, K, or E; $Xaa_{23}$ is Q or K; $Xaa_{30}$ is A or E; $Xaa_{33}$ is V or K; $Xaa_{34}$ is K, N, or R; $Xaa_{36}$ is R or G; and $Xaa_{37}$ is G, H, P, or absent (SEQ ID NO: 1247): $Arg^{34}$-GLP-1(7-37) (SEQ ID NO: 1248): $Glu^{30}$-GLP-1(7-37) (SEQ ID NO: 1249); $Lys^{22}$-GLP-1(7-37) (SEQ ID NO: 1250): $Gly^{8,36}$, $Glu^{22}$-GLP-1(7-37) (SEQ ID NO: 1251); $Val^8$,$Glu^{22}$,$Gly^{36}$-GLP-1(7-37) (SEQ ID NO: 1252), $G^{8,36}$,$Glu^{22}$,$Lys^{33}$,$Asn^{34}$-GLP-1(7-37) (SEQ ID NO: 1253); $Val^8$,$Glu^{22}$,$Lys^{33}$,$Asn^{34}$, $Gly^{36}$-GLP-1(7-37) (SEQ ID NO: 1254); $Gly^{8,36}$,$Glu^{22}$, $Pro^{37}$-GLP-1(7-37) (SEQ ID NO: 1255); $Val^8$,$Glu^{22}$, $Gly^{36}Pro^{37}$-GLP-1(7-37) (SEQ ID NO: 1256); $Gly^{8,36}$, $Glu^{22}$,$Lys^{33}$, $Asn^{34}$,$Pro^{37}$-GLP-1(7-37) (SEQ ID NO: 1257); $Val^8$,$Glu^{22}$,$Lys^{33}$,$Asn^{34}$,$Gly^{36}$,$Pro^{37}$-GLP-1(7-37) (SEQ ID NO: 1258); $Gly^{8,36}$,$Glu^{22}$-GLP-1(7-36) (SEQ ID NO: 1259); $Val^8$,$Glu^{22}$,$Gly^{36}$-GLP-1(7-36) (SEQ ID NO: 1260); $Val^8$,$Glu^{22}$,$Asn^{34}$,$Gly^{36}$-GLP-1(7-36) (SEQ ID NO: 1261): $Gly^{8,36}$,$Glu^{22}$,$Asn^{34}$-GLP-1(7-36) (SEQ ID NO: 1262). Each of the GLP-1(7-37) and GLP-1(7-37) analogs may optionally be amidated.

In one embodiment, the GLP-1(7-37) or GLP-1(7-37) analogs are covalently linked (directly or by a linking group) to an Fc portion of an immunoglobulin (e.g., IgG, IgE, IgG, and the like). For example, any one of SEQ ID NOs:25-40 may be covalently linked to the Fc portion of an immunoglobulin comprising the sequence of: $AESKYGPPCPPCPAPXaa_{16}Xaa_{17}Xaa_{18}GGPSVFLFPPKPKDTLMISRTPEVTCVVVDVSQEDPEVQFNWYVDGVEVHNAKTKPREEQFXaa_{80}STYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGXaa_{230}$; wherein $Xaa_{16}$ is P or E; $Xaa_{17}$ is F, V or A; $Xaa_{18}$ is L, E or A; $Xaa_{80}$ is N or A; and $Xaa_{230}$ is K or absent (SEQ ID NO: 1263). The linking group may be any chemical moiety (e.g., amino acids and/or chemical groups). In one embodiment, the linking group is $(\text{-GGGGS-})_x$ (SEQ ID NO: 1264) where x is 1, 2, 3, 4, 5 or 6; preferably 2, 3 or 4; more preferably 3. In one embodiment, the GLP-1(7-37) analog covalently linked to the Fc portion of an immunoglobulin comprises the amino acid sequence:

```
                                          (SEQ ID NO: 1265)
HGEGTFTSDVSSYLEEQAAKEFIAWLVKGGGGGGGSGGGGSGGGGSAESKY

GPPCPPCPAPEAAGGPSVFLFPPKPKDTLMISRTPEVTCVVVDVSQEDPEV

QFNWYVDGVEVHNAKTKPREEQFNSTYRVVSVLTVLHQDWLNGKEYKCKVS

NKGLPSSIEKTISKAKGQPREPQVYTLPPSQEEMTKNQVSLTCLVKGFYPS

DIAVEWESNGQPENNYKTTPPVLDSDGSFFLYSRLTVDKSRWQEGNVFSCS

VMHEALHNHYTQKSLSLSLG.
```

In another embodiment, the GLP-1(7-37) or GLP-1(7-37) analog may be covalently linked (directly or through a linking group) to one or two polyethylene glycol molecules. For example, a GLP-1(7-37) analog may comprise the amino acid sequence: $HXaa_8EGTFTSDVSSYLEXaa_{22}QAAKEFIAWLXaa_{33}KGGPSSGAPPPC_{45}C_{46}$-Z, wherein $Xaa_8$ is: D-Ala, G, V, L, I, S or T; $Xaa_{22}$ is G, E, D or K; $Xaa_{33}$ is: V or I; and Z is OH or $NH_2$, (SEQ ID NO: 1266), and, optionally, wherein (i) one polyethylene glycol moiety is covalently attached to $C_{45}$, (ii) one polyethylene glycol moiety is covalently attached to $C_{46}$, or (iii) one polyethylene glycol moiety is attached to $C_{45}$ and one polyethylene glycol moiety is attached to $C_{46}$. In one embodiment, the GLP-1(7-37) analog is HVEGTFTSDVSSYLEEQAAKEFI AWLIKGGPSSGAPPP$C_{45}C_{46}$—$NH_2$ (SEQ ID NO: 1267) and, optionally, wherein (i) one polyethylene glycol moiety is covalently attached to $C_4$, (ii) one polyethylene glycol moiety is covalently attached to $C_{46}$, or (iii) one polyethylene glycol moiety is attached to $C_{45}$ and one polyethylene glycol moiety is attached to $C_{46}$.

In one embodiment, the GLP-1 receptor agonist compound is a peptide that has at least 80% sequence identity to GLP-1(7-37) (SEQ ID NO: 1244); at least 85% sequence identity to GLP-1(7-37) (SEQ ID NO: 1244); at least 90% sequence identity to GLP-1(7-37) (SEQ ID NO: 1244); or at least 95% sequence identity to GLP-1(7-37) (SEQ ID NO: 1244).

GLP-1 receptor agonist compounds may be prepared by processes well known in the art, e.g., peptide purification as described in Eng et al., *J. Biol. Chem.,* 265:20259-62 (1990); standard solid-phase peptide synthesis techniques as described in Raufman et al., *J. Biol. Chem.,* 267:21432-37 (1992); recombinant DNA techniques as described in Sambrook et al., *Molecular Cloning: A Laboratory Manual, 2d Ed., Cold Spring Harbor* (1989); and the like.

TABLE 7

Examples of GLP-1 Agonist Sequences

| SEQ ID NO: | Sequence | Description |
|---|---|---|
| 1223 | HGEGTFTSDLSKQMEEEAVRLFIEWLKN GGPSSGAPPPS | Exendin-4 |
| 1224 | HSDGTFTSDLSKQMEEEAVRLFIEWLKN GGPSSGAPPPS | Exendin-3 |
| 1225 | HGEGTFTSDLSKQLEEEAVRLFIEWLKN GGPSSGAPPPS | $Leu^{14}$-exendin-4 |
| 1226 | HGEGTFTSDLSKQLEEEAVRLFIEFLKN GGPSSGAPPPS | $Leu^{14}$, $Phe^{25}$-exendin-4 |
| 1227 | HGEGTFTSDLSKQLEEEAARLFIEFLKN GGPSSGAPPPS | $Leu^{14}$, $Ala^{19}$, $Phe^{25}$-exendin-4 |
| 1228 | HGEGTFTSDLSKQMEEEAVRLFIEWLKN GG | exendin-4(1-30) |
| 1229 | HGEGTFTSDLSKQLEEEAVRLFIEWLKN GG | $Leu^{14}$-exendin-4(1-30) |
| 1230 | HGEGTFTSDLSKQLEEEAVRLFIEFLKN GG | $Leu^{14}$, $Phe^{25}$-exendin-4(1-30) |
| 1231 | HGEGTFTSDLSKQLEEEAARLFIEFLKN GG | $Leu^{14}$, $Ala^{19}$, $Phe^{25}$-exendin-4(1-30) |
| 1232 | HGEGTFTSDLSKQMEEEAVRLFIEWLKN | exendin-4(1-28) |
| 1233 | HGEGTFTSDLSKQLEEEAVRLFIEWLKN | $Leu^{14}$-exendin-4(1-28) |
| 1234 | HGEGTFTSDLSKQLEEEAVRLFIEFLKN | $Leu^{14}$, $Phe^{25}$-exendin-4(1-28) |
| 1235 | HGEGTFTSDLSKQLEEEAARLFIEFLKN | $Leu^{14}$, $Ala^{19}$, $Phe^{25}$-exendin-4(1-28) |
| 1236 | HGEGTFTSDLSKQLEEKAAKEFIEFLKQ GGPSSGAPPPS | $Leu^{14}$, $Lys^{17,20}$, $Ala^{19}$, $Glu^{21}$, $Phe^{25}$, $Gln^{28}$-exendin-4 |
| 1237 | HGEGTFTSDLSKQLEEKAAKEFIEWLKQ GGPSSGAPPPS | $Leu^{14}$, $Lys^{17,20}$, $Ala^{19}$, $Glu^{21}$, $Gln^{28}$-exendin-4 |
| 1238 | HGEGTFTSDLSKQ(octylG)EEEAVRL FIEWLKQGGPSSGAPPPS | $octylGly^{14}$, $Gln^{28}$-exendin-4 |
| 1239 | HGEGTFTSDLSKQLEEEAVRLFIEWLKQ GGPSS(octylG)APPPS | $Leu^{14}$, $Gln^{28}$, $octylGly^{34}$-exendin-4 |
| 1240 | HGEFTFTSDLSKQLEEEAVRLFIEWLKQ GGPSKEIIS | $Phe^{4}$, $Leu^{14}$, $Gln^{28}$, $Lys^{33}$, $Glu^{34}$, $Ile^{35,36}$, $Ser^{37}$-exendin-4(1-37) |
| 1241 | HGEFTFTSDLSKQLEEKAAKEFIEWLKQ GGPSSGAPPPS | $Phe^{4}$, $Leu^{14}$, $Lys^{17,20}$, $Ala^{19}$, $Glu^{21}$, $Gln^{28}$-exendin-4 |
| 1242 | HGEGTFTSDLVKILEAEAVRKFIEFLKN GGPSSGAPPPS | $Val^{11}$, $Ile^{13}$, $Leu^{14}$, $Ala^{16}$, $Lys^{21}$, $phe^{25}$-exendin-4 |
| 1243 | HGEGTFTSDLSKQMEEEAVRLFIEWLKN GGPSSGAPPPSK | exendin-4-$Lys^{40}$ |
| 1244 | HAEGTFTSDVSSYLEGQAAKEFIAWLVK GRG | GLP-1(7-37) |
| 1245 | HAEGTFTSDVSSYLEGQAAKEFIAWLVK GR | GLP-1(7-36)-$NH_2$ |
| 1246 | H(Aib)EGTFTSDVSSYLEGQAAREFIA FLVR(Aib)R | $Aib^{8,35}$, $Arg^{26,34}$, $Phe^{31}$-GLP-1(7-36)) |
| 1247 | $HXaa_8EGTFTSDVSSYLEXaa_{22}Xaa_{23}AA$ KEFI $Xaa_{30}WLXaa_{33}Xaa_{34}GXaa_{36}Xaa_{37}$ wherein $Xaa_8$ is A, V, or G $Xaa_{22}$ is G, K, or E $Xaa_{23}$ is Q or K $Xaa_{30}$ is A or E | $HXaa_8EGTFTSDVSSYLEXaa_{22}Xaa_{23}$ $AAKEFIXaa_{30}WLXaa_{33}Xaa_{34}$ G $Xaa_{36}Xaa_{37}$ wherein $Xaa_8$ is A, V, or G $Xaa_{22}$ is G, K, or E $Xaa_{23}$ is Q or K $Xaa_{30}$ is A or E |

TABLE 7-continued

Examples of GLP-1 Agonist Sequences

| SEQ ID NO: | Sequence | Description |
|---|---|---|
| | $Xaa_{33}$ is V or K<br>$Xaa_{34}$ is K, N, or R<br>$Xaa_{36}$ is R or G<br>and $Xaa_{37}$ is G, H, P, or absent | $Xaa_{33}$ is V or K<br>$Xaa_{34}$ is K, N, or R<br>$Xaa_{36}$ is R or G<br>and $Xaa_{37}$ is G, H, P or absent |
| 1248 | HAEGTFTSDVSSYLEGQAAKEFIAWLVR GRG | $Arg^{34}$-GLP-1(7-37) |
| 1249 | HAEGTFTSDVSSYLEGQAAKEFIEWLVK GRG | $Glu^{30}$-GLP-1(7-37) |
| 1250 | HAEGTFTSDVSSYLEKQAAKEFIAWLVK GRG | $Lys^{22}$-GLP-1(7-37) |
| 1251 | HGEGTFTSDVSSYLEEQAAKEFIAWLVK GGG | $Gly^{8,36}$,$Glu^{22}$-GLP-1(7-37) |
| 1252 | HVEGTFTSDVSSYLEEQAAKEFIAWLVK GGG | $Val^{8}$,$Glu^{22}$,$Gly^{36}$-GLP-1(7-37) |
| 1253 | HGEGTFTSDVSSYLEEQAAKEFIAWLKN GGG | $Gly^{8,36}$,$Glu^{22}$,$Lys^{33}$,$Asn^{34}$-Glp-1(7-37) |
| 1254 | HVEGTFTSDVSSYLEEQAAKEFIAWLKN GGG | $Val^{8}$,$Glu^{22}$,$Lys^{33}$,$Asn^{34}$,$Gly^{36}$-GLP-1(7-37) |
| 1255 | HGEGTFTSDVSSYLEEQAAKEFIAWLVK GGP | $Gly^{8,36}$,$Glu^{22}$,$Pro^{37}$-GLP-1(7-37) |
| 1256 | HVEGTFTSDVSSYLEEQAAKEFIAWLVK GGP | $Val^{8}$,$Glu^{22}$,$Gly^{36}$,$Pro^{37}$-GLP-1(7-37) |
| 1257 | HGEGTFTSDVSSYLEEQAAKEFIAWLKN GGP | $Gly^{8,36}$,$Glu^{22}$,$Lys^{33}$,$Asn^{34}$,$Pro^{37}$-GLP-1(7-37) |
| 1258 | HVEGTFTSDVSSYLEEQAAKEFIAWLKN GGP | $Val^{8}$,$Glu^{22}$,$Lys^{33}$,$Asn^{34}$,$Gly^{36}$,$Pro^{37}$-GLP-1(7-37) |
| 1259 | HGEGTFTSDVSSYLEEQAAKEFIAWLVK GG | $Gly^{8,36}$,$Glu^{22}$-GLP-1(7-36) |
| 1260 | HVEGTFTSDVSSYLEEQAAKEFIAWLVK GG | $Val^{8}$,$Glu^{22}$,$Gly^{36}$-GLP-1(7-36) |
| 1261 | HVEGTFTSDVSSYLEEQAAKEFIAWLVN GG | $Val^{8}$,$Glu^{22}$,$Asn^{34}$,$Gly^{36}$-GLP-1(7-36) |
| 1262 | HGEGTFTSDVSSYLEEQAAKEFIAWLVN GG | $Gly^{8,36}$,$Glu^{22}$,$Asn^{34}$-GLP-1(7-36) |
| 1263 | AESKYGPPCPPCPAPX$aa_{16}$X$aa_{17}$X$aa_{18}$<br>GGPSVFLFPPKPKDTLMISRTPEVTCVV<br>VDVSQEDPEVQFNWYVDGVEVHNAKTKP<br>REEQFX$aa_{80}$STYRVVSVLTVLHDWLNG<br>KEYKCKVSNKGLPSSIEKTISKAKGQPR<br>EPQVYTLPPSQEEMTKNQVSLTCLVKGF<br>YPSDIAVEWESNGQPENNYKTTPPVLDS<br>DGSFFLYSRLTVDKSRWQEGNVFSCSVM<br>HEALHNHYTQKSLSLSLGX$aa_{230}$<br>wherein $Xaa_{16}$, is P or E<br>$Xaa_{17}$ is F, V or A<br>$Xaa_{18}$ is L, E or A<br>$Xaa_{80}$ is N or A<br>and $Xaa_{230}$ is K or absent | Fc portion of an immunoglobulin |
| 1264 | $(\text{-GGGGS-})_x$ where x is 1, 2, 3, 4, 5 or 6 | Linker |
| 1265 | HGEGTFTSDVSSYLEEQAAKEEIAWLVK<br>GGGGGGGSGGGGSGGGGSAESKYGPPCP<br>PCPAPEAAGGPSVFLEPPKPKDTLMISR<br>TPEVTCVVVDVSQEDPEVQFNWYVDGVE<br>VHNAKTKPREEQFNSTYRVVSVLTVLHQ<br>DWLNGKEYKCKVSNKGLPSSIEKTISKA | Fc portion of an immunoglobulin |

TABLE 7-continued

Examples of GLP-1 Agonist Sequences

| SEQ ID NO: | Sequence | Description |
|---|---|---|
| | KGQPREPQVYTLPPSQEEMTKNQVSLTC LVKGFYPSDIAVEWESNGQPENNYKTTP PVLDSDGSFFLYSR LTVDKSRWQEGNVFSCSVMHEALHNHYT QKSLSLSLG | |
| 1266 | HXaa$_8$EGTFTSDVS SYLEXaa$_{22}$QAAKEFIAWLXaa$_{33}$KGGPSS GAPPPC$_{45}$C$_{46}$-Z, wherein Xaa$_8$ is: D-Ala, G, V, L, I, S or T Xaa$^{22}$ is G, E, D or K Xaa$^{33}$ is: V or I and Z is OH or NH$_2$ and, optionally, wherein (i) one polyethylene glycol moiety is covalently attached to C$_{45}$, (ii) one polyethylene glycol moiety is covalently attached to C$_{46}$, or (iii) one polyethylene glycol moiety is attached to C$_{45}$ and one polyethylene glycol moiety is attached to C$_{46}$. | GLP analog |
| 1267 | HVEGTETSDVSSYLEEQAAKEFIAWLIK GGPSSGAPPPC$_{45}$C$_{46}$-NH$_2$ and, optionally, wherein (i) one polyethylene glycol moiety is covalently attached to C$_{4,}$ (ii) one polyethylene glycol moiety is covalently attached to C$_{46}$, or (iii) one polyethylene glycol moiety is attached to C$_{45}$ and one polyethylene glycol moiety is attached to C$_{46}$ | GLP analog |
| 1268 | HGEGTFTSDLSKQMEEEAVKLFIEWLKN GGPSSGAPPPS | [$N^e$-(17-carboxyheptadecanoic acid)Lys$^{20}$]exendin-4-NH$_2$ |
| 1269 | HGEGTFTSDLSKQMEEEAVRLFIEWLKN GGPKSGAPPPS | [$N^e$-(17-carboxyhepta-decanoyl)LyS$^{32}$]exendin-4-NH$_2$ |
| 1270 | GEGTFTSDLSKQMEEEAVKLFIEWLKNG GPSSGAPPPS | [desamino-His$^1$,$N^e$-(17-carboxyheptadecanoyl)Lys$^{20}$] exendin-4-NH$_2$ |
| 1271 | HGEGTFTSDLSRQNorLeEEEAVRLFIE WLRNGGPKSGAPPPS | [Arg$^{12,27}$,NLe$^{14}$,$N^e$-(17-carboxy-heptadecanoyl)Lys$^{32}$]exendin-4-NH$_2$ |
| 1272 | HGEGTFTSDLSKQMEEEAVKLFIEWLKN GGPSSGAPPPS | [$N^e$-(19-carboxy-nonadecanoylamino)Lys$^{20}$]-exendin-4-NH$_2$ |
| 1273 | HGEGTFTSDLSKQMEEEAVKLFIEWLKN GGPSSGAPPPS | [$N^e$-(15-carboxypentadecanoylamino)Lys$^{20}$]-exendin-4-NH$_2$ |
| 1274 | HGEGTFTSDLSKQMEEEAVKLFIEWLKN GGPSSGAPPPS | [$N^e$-(13-carboxytridecanoylamino)Lys$^{20}$] exendin-4-NH$_2$ |
| 1275 | HGEGTFTSDLSKQMEEEAVKLFIEWLKN GGPSSGAPPPS | [$N^e$-(11-carboxy-undecanoyl-amino)Lys$^{20}$]exendin-4-NH$_2$ |
| 1276 | HGEGTFTSDLSKQMEEEAVRLFIEWLKN GGPSSGAPPPSK | exendin-4-Lys$^{40}$(e-MPA)-NH$_2$ |
| 1277 | HGEGTFTSDLSKQMEEEAVRLFIEWLKN GGPSSGAPPPSK | exendin-4-Lys$^{40}$(e-AEEA-AEEA-MPA)-NH$_2$ |
| 1278 | HGEGTFTSDLSKQMEEEAVRLFIEWLKN GGPSSGAPPPSK | exendin-4-Lys$^{40}$(e-AEEA-MPA)-NH$_2$ |

TABLE 7-continued

Examples of GLP-1 Agonist Sequences

| SEQ ID NO: | Sequence | Description |
|---|---|---|
| 1279 | HGEGTFTSDLSKQMEEEAVRLFIEWLKN GGPSSGAPPPSK | exendin-4-Lys$^{40}$(e-MPA)-albumin |
| 1280 | HGEGTFTSDLSKQMEEEAVRLFIEWLKN GGPSSGAPPPSK | exendin-4-Lys$^{40}$(e-AEEA-AEEA-MPA)-albumin |
| 1281 | HGEGTFTSDLSKQMEEEAVRLFIEWLKN GGPSSGAPPPSK | exendin-4-Lys$^{40}$(e-AEEA-MPA)-albumin |
| 1282 | AEGTFTSDVSSYLEGQAAREFIAWLVKG RG | desamino-His$^{7}$,Arg$^{26}$,Lys$^{34}$(N$^{\varepsilon}$-(γ-Glu(N-α-hexadecanoyl)))-GLP-1(7-37) (core peptide disclosed as SEQ ID NO: 1282) |
| 1283 | AEGTFTSDVSSYLEGQAAREFIAWLVKG RG | desamino-His$^{7}$,Arg$^{26}$,Lys$^{34}$(N$^{\varepsilon}$-octanoyl)-GLP-1(7-37) |
| 1284 | HAEGTFTSDVSSYLEGQAAREFIAWLVR GRGK | Arg$^{26,34}$,Lys$^{38}$(N$^{\varepsilon}$-(ω-carboxy pentadecanoyl))-GLP-1(7-38) |
| 1285 | HAEGTFTSDVSSYLEGQAAREFIAWLVR GRGK | Arg$^{26,34}$,Lys$^{36}$(N$^{\varepsilon}$-(γ-Glu(N-α-hexadecanoyl)))-GLP-1(7-36) (core peptide disclosed as SEQ ID NO: 1285) |

AEEA refers to [2-(2-amino)ethoxy)]acetic acid

EDA refers to ethylenediamine.

MPA refers to maleimidopropionic acid.

The disclosure also provides pharmaceutical compositions comprising the GLP-1 receptor agonist compounds described herein and a pharmaceutically acceptable carrier. The GLP-1 receptor agonist compounds can be present in the pharmaceutical composition in a therapeutically effective amount and can be present in an amount to provide a minimum blood plasma level of the GLP-1 receptor agonist compound necessary for therapeutic efficacy. Such pharmaceutical compositions are known in the art and described, e.g., in U.S. Pat. Nos. 7,521,423; 7,456,254; WO 2000/037098; WO 2005/021022; WO 2005/102293; WO 2006/068910; WO 2006/125763; WO 2009/068910; US Publication No. 2004/0106547; and the like, the disclosures of which are incorporated herein by reference.

Pharmaceutical compositions containing the GLP-1 receptor agonist compounds described herein may be provided for peripheral administration, such as parenteral (e.g., subcutaneous, intravenous, intramuscular), a continuous infusion (e.g., intravenous drip, intravenous bolus, intravenous infusion), topical, nasal, or oral administration. Suitable pharmaceutically acceptable carriers and their formulation are described in standard formulation treatises, such as Remington's Pharmaceutical Sciences by Martin; and Wang et al., *Journal of Parenteral Science and Technology*, Technical Report No. 10, Supp. 42:2S (1988). The GLP-1 receptor agonist compounds described herein can be provided in parenteral compositions for injection or infusion. They can, for example, be suspended in water; an inert oil, such as a vegetable oil (e.g., sesame, peanut, olive oil, and the like); or other pharmaceutically acceptable carrier. In one embodiment, the compounds are suspended in an aqueous carrier, for example, in an isotonic buffer solution at a pH of about 3.0 to 8.0, or about 3.0 to 5.0. The compositions may be sterilized by conventional sterilization techniques or may be sterile filtered. The compositions may contain pharmaceutically acceptable auxiliary substances as required to approximate physiological conditions, such as pH buffering agents.

Useful buffers include for example, acetic acid buffers. A form of repository or "depot" slow release preparation may be used so that therapeutically effective amounts of the preparation are delivered into the bloodstream over many hours or days following subcutaneous injection, transdermal injection or other delivery method. The desired isotonicity may be accomplished using sodium chloride or other pharmaceutically acceptable agents such as dextrose, boric acid, sodium tartrate, propylene glycol, polyols (such as mannitol and sorbitol), or other inorganic or organic solutes. In one embodiment for intravenous infusion, the formulation may comprise (i) the GLP-1 receptor agonist compound, (2) sterile water, and, optionally (3) sodium chloride, dextrose, or a combination thereof.

Carriers or excipients can also be used to facilitate administration of the GLP-1 receptor agonist compounds. Examples of carriers and excipients include calcium carbonate, calcium phosphate, various sugars such as lactose, glucose, or sucrose, or types of starch, cellulose derivatives, gelatin, vegetable oils, polyethylene glycols and physiologically compatible solvents.

The GLP-1 receptor agonist compounds can also be formulated as pharmaceutically acceptable salts (e.g., acid addition salts) and/or complexes thereof. Pharmaceutically acceptable salts are non-toxic salts at the concentration at which they are administered. Pharmaceutically acceptable salts include acid addition salts such as those containing sulfate, hydrochloride, phosphate, sulfamate, acetate, citrate, lactate, tartrate, methanesulfonate, ethanesulfonate, benzenesulfonate, p-toluenesulfonate, cyclohexylsulfamate and quinate. Pharmaceutically acceptable salts can be obtained from acids such as hydrochloric acid, sulfuric acid, phosphoric acid, sulfamic acid, acetic acid, citric acid, lactic acid, tartaric acid, malonic acid, methanesulfonic acid, ethanesulfonic acid, benzenesulfonic acid, p-toluenesulfonic acid, cyclohexylsulfamic acid, and quinic acid. Such salts may be prepared by, for example, reacting the free acid or base forms of the product with one or more equivalents of the appropriate base or acid in a solvent or medium in which the salt is insoluble, or in a solvent such as water which is then removed in vacuo or by freeze-drying or by exchanging the ions of an existing salt for another ion on a suitable ion exchange resin.

Exemplary pharmaceutical formulations of GLP-1 receptor agonist compounds are described in U.S. Pat. Nos. 7,521,423, 7,456,254; US Publication No 2004/0106547, WO 2006/068910, WO 2006/125763, and the like, the disclosures of which are incorporated by reference herein.

The therapeutically effective amount of the GLP-1 receptor agonist compounds described herein for use in the methods described herein will typically be from about 0.01 μg to about 5 mg; about 0.1 μg to about 2.5 mg; about 1 μg to about 1 mg; about 1 μg to about 50 μg; or about 1 μg to about 25 μg. Alternatively, the therapeutically effective amount of the GLP-1 receptor agonist compounds may be from about 0.001 μg to about 100 μg based on the weight of a 70 kg patient; or from about 0.01 μg to about 50 μg based on the weight of a 70 kg patient. These therapeutically effective doses may be administered once/day, twice/day, thrice/day, once/week, biweekly, or once/month, depending on the formulation. The exact dose to be administered is determined, for example, by the formulation, such as an immediate release formulation or an extended release formulation. For transdermal, nasal or oral dosage forms, the dosage may be increased from about 5-fold to about 10-fold.

In certain embodiments the GLP-1 receptor agonist will be administered concurrently with the GIPR antigen binding protein. In one embodiment the GLP-1 receptor agonist will be administered after the GIPR antigen binding protein. In one embodiment the GLP-1 receptor agonist will be administered before the GIPR antigen binding protein. In certain embodiments the subject or patient will already be being treated with a GLP-1 receptor agonist before being subjected to further treatment with a GIPR antigen binding protein.

The GIPR antigen binding proteins that are provided herein are useful for detecting GIPR in biological samples. For instance, the GIPR antigen binding proteins can be used in diagnostic assays, e.g., binding assays to detect and/or quantify GIPR expressed in serum.

The antigen binding proteins of the described can be used for diagnostic purposes to detect, diagnose, or monitor diseases and/or conditions associated with GIPR. The disclosed antigen binding proteins provide a means for the detection of the presence of GIPR in a sample using classical immunohistological methods known to those of skill in the art (e.g., Tijssen, 1993, *Practice and Theory of Enzyme Immunoassays*, Vol 15 (Eds R. H. Burdon and P. H. van Knippenberg, Elsevier, Amsterdam); Zola, 1987, *Monoclonal Antibodies: A Manual of Techniques*, pp. 147-158 (CRC Press, Inc.); Jalkanen et al., 1985, *J. Cell. Biol.* 101:976-985; Jalkanen et al., 1987, *J. Cell Biol.* 105:3087-3096). The detection of GIPR can be performed in vivo or in vitro.

Diagnostic applications provided herein include use of the antigen binding proteins to detect expression of GIPR. Examples of methods useful in the detection of the presence of GIPR include immunoassays, such as the enzyme linked immunosorbent assay (ELISA) and the radioimmunoassay (RIA).

For diagnostic applications, the antigen binding protein typically will be labeled with a detectable labeling group. Suitable labeling groups include, but are not limited to, the following: radioisotopes or radionuclides (e.g., $^{3}H$, $^{14}C$, $^{15}N$, $^{35}S$, $^{90}Y$, $^{99}Tc$, $^{111}In$, $^{125}I$, $^{131}I$), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labeling group is coupled to the antigen binding protein via spacer arms of various lengths to reduce potential steric hindrance. Various methods for labeling proteins are known in the art and may be used.

In some embodiments, the GIPR antigen binding protein is isolated and measured using techniques known in the art. See, for example, Harlow and Lane, 1988, *Antibodies: A Laboratory Manual*, New York: Cold Spring Harbor (ed. 1991 and periodic supplements); John E. Coligan, ed., 1993, *Current Protocols In Immunology* New York: John Wiley & Sons.

Another aspect of the disclosed provides for detecting the presence of a test molecule that competes for binding to GIPR with the antigen binding proteins provided. An example of one such assay would involve detecting the amount of free antigen binding protein in a solution containing an amount of GIPR in the presence or absence of the test molecule. An increase in the amount of free antigen binding protein (i.e., the antigen binding protein not bound to GIPR) would indicate that the test molecule is capable of competing for GIPR binding with the antigen binding protein. In one embodiment, the antigen binding protein is labeled with a labeling group. Alternatively, the test molecule is labeled and the amount of free test molecule is monitored in the presence and absence of an antigen binding protein.

GIPR binding proteins can be used to treat, diagnose or ameliorate, a metabolic condition or disorder. In one embodiment, the metabolic disorder to be treated is diabetes, e.g., type 2 diabetes. In another embodiment, the metabolic condition or disorder is obesity. In other embodiments the metabolic condition or disorder is dyslipidemia, elevated glucose levels, elevated insulin levels or diabetic nephropathy. For example, a metabolic condition or disorder that can be treated or ameliorated using a GIPR binding peptide includes a state in which a human subject has a fasting blood glucose level of 125 mg/dL or greater, for example 130, 135, 140, 145, 150, 155, 160, 165, 170, 175, 180, 185, 190, 195, 200 or greater than 200 mg/dL. Blood glucose levels can be determined in the fed or fasted state, or at random. The metabolic condition or disorder can also comprise a condition in which a subject is at increased risk of developing a metabolic condition. For a human subject, such conditions include a fasting blood glucose level of 100 mg/dL. Conditions that can be treated using a pharmaceutical composition comprising a GIPR binding protein can also be found in the American Diabetes Association Standards of Medical Care in Diabetes Care-2011, American Diabetes Association, Diabetes Care Vol. 34, No. Supplement 1, S11-S61, 2010, incorporated herein by reference.

In application, a metabolic disorder or condition, such as Type 2 diabetes, elevated glucose levels, elevated insulin levels, dyslipidemia, obesity or diabetic nephropathy, can be treated by administering a therapeutically effective dose of a GIPR binding protein to a patient in need thereof. The administration can be performed as described herein, such as by IV injection, intraperitoneal (IP) injection, subcutaneous injection, intramuscular injection, or orally in the form of a tablet or liquid formation. In some situations, a therapeutically effective or preferred dose of a GIPR binding protein can be determined by a clinician. A therapeutically effective dose of GIPR binding protein will depend, inter alia, upon the administration schedule, the unit dose of agent administered, whether the GIPR binding protein is administered in combination with other therapeutic agents, the immune status and the health of the recipient. The term "therapeutically effective dose," as used herein, means an amount of GIPR binding protein that elicits a biological or medicinal response in a tissue system, animal, or human being sought by a researcher, medical doctor, or other clinician, which includes alleviation or amelioration of the symptoms of the disease or disorder being treated, i.e., an amount of a GIPR binding protein that supports an observable level of one or more desired biological or medicinal response, for example lowering blood glucose, insulin, triglyceride, or cholesterol levels; reducing body weight; or improving glucose tolerance, energy expenditure, or insulin sensitivity.

It is noted that a therapeutically effective dose of a GIPR binding protein can also vary with the desired result. Thus, for example, in situations in which a lower level of blood glucose is indicated a dose of GIPR binding protein will be correspondingly higher than a dose in which a comparatively lower level of blood glucose is desired. Conversely, in situations in which a higher level of blood glucose is indicated a dose of GIPR binding protein will be correspondingly lower than a dose in which a comparatively higher level of blood glucose is desired.

In various embodiments, a subject is a human having a blood glucose level of 100 mg/dL or greater can be treated with a GIPR binding protein.

In one embodiment, a method of the instant disclosure comprises first measuring a baseline level of one or more metabolically-relevant compounds such as glucose, insulin, cholesterol, lipid in a subject. A pharmaceutical composition comprising a GIPR binding protein is then administered to the subject. After a desired period of time, the level of the one or more metabolically-relevant compounds (e.g., blood glucose, insulin, cholesterol, lipid) in the subject is again measured. The two levels can then be compared in order to determine the relative change in the metabolically-relevant compound in the subject. Depending on the outcome of that comparison another dose of the pharmaceutical composition comprising a GIPR binding protein can be administered to achieve a desired level of one or more metabolically-relevant compound.

It is noted that a pharmaceutical composition comprising a GIPR binding protein can be co-administered with another compound. The identity and properties of compound co-administered with the GIPR binding protein will depend on the nature of the condition to be treated or ameliorated. A non-limiting list of examples of compounds that can be administered in combination with a pharmaceutical composition comprising a GIPR binding protein include rosiglitizone, pioglitizone, repaglinide, nateglitinide, metformin, exenatide, stiagliptin, pramlintide, glipizide, glimeprirideacarbose, and miglitol.

Also provided are kits for practicing the disclosed methods. Such kits can comprise a pharmaceutical composition such as those described herein, including nucleic acids encoding the peptides or proteins provided herein, vectors and cells comprising such nucleic acids, and pharmaceutical compositions comprising such nucleic acid-containing compounds, which can be provided in a sterile container. Optionally, instructions on how to employ the provided pharmaceutical composition in the treatment of a metabolic disorder can also be included or be made available to a patient or a medical service provider.

In one aspect, a kit comprises (a) a pharmaceutical composition comprising a therapeutically effective amount of a GIPR binding protein; and (b) one or more containers for the pharmaceutical composition. Such a kit can also comprise instructions for the use thereof; the instructions can be tailored to the precise metabolic disorder being treated. The instructions can describe the use and nature of the materials provided in the kit. In certain embodiments, kits include instructions for a patient to carry out administration to treat a metabolic disorder, such as elevated glucose levels, elevated insulin levels, obesity, type 2 diabetes, dyslipidemia or diabetic nephropathy.

Instructions can be printed on a substrate, such as paper or plastic, etc., and can be present in the kits as a package insert, in the labeling of the container of the kit or components thereof (e.g., associated with the packaging), etc. In other embodiments, the instructions are present as an electronic storage data file present on a suitable computer readable storage medium, e.g. CD-ROM, diskette, etc. In yet other embodiments, the actual instructions are not present in the kit, but means for obtaining the instructions from a remote source, such as over the internet, are provided. An example of this embodiment is a kit that includes a web address where the instructions can be viewed and/or from which the instructions can be downloaded.

Often it will be desirable that some or all components of a kit are packaged in suitable packaging to maintain sterility. The components of a kit can be packaged in a kit containment element to make a single, easily handled unit, where the kit containment element, e.g., box or analogous structure, may or may not be an airtight container, e.g., to further preserve the sterility of some or all of the components of the kit.

Example 1

Materials and Methods—Yeast Display

Construction of the yeast displayed molecules and libraries used gBlocks and degenerate codon primers (IDT DNA). Standard PCR and overlap assembly PCR was done using Q5 HotStart polymerase (NEB). Transformation by electroporation into yeast strain BJ5464 (ATCC) was done using homologus recombination of inserts and digested vector previously purified through PCR purification kits (Qiagen). Briefly, BJ5464 cells were picked from YPD agar plates and grown overnight at 30° C. in YPD media. Cells were then expanded to a starting OD of 0.2 and grown for 6 hrs at 30° C. After pelleting and resuspension in room temperature 10 mM Tris, 100 mM LiOAc, 0.6 M sorbitol, 10 mM DTT was added followed by a 30 min incubation at RT with gentle shaking at 220 rpm. Cells were pelleted and washed in cold 1 M sorbitol, 1 mM $CaCl_2$ and resuspended at $2\times10^{10}$ cells/mL. Electroporation of 0.5 ug of DNA in 5 uL volume/cuvette with 120 uL of cells using the following setttings: 540 V; 25 uF; ∞ ohms. Cells were quickly rescued with 2 mL of YPD, 0.5 M sorbitol, 0.5 mM $CaCl_2$. Following a 1 hr recovery at 30° C., cells were transferred to SCDDextrose media without Leucine or Uracil and passaged for 2 days at 30° C. Induction of displayed Fab molecules was done through media change into SCD Galactose media allowing the activation of the Gal10 promotor. Cells we induced for 48 hrs at 20° C. Surface displayed molecules were evaluated using an Alexafluor 647 conjugated anti-huFab antibody to measure amount of displayed molecules. Antigen binding was measured with a biotin conjugated GIPR ECD fragment 21-129aa along with a streptavidin PE molecule. Fluorescence was measured using a BD Canto or sorted using an AriaII FACS. Yeast were sorted and then grown on SCD-leu-ura agar plates. Following 2-3 days growth at 30° C., clones were picked and grown in SCD-leu-ura media. PCR was done from yeast cultures using Phire Plant Direct PCR (ThermoFisher). PCR samples were then sequenced by Genewiz.

Molecular Biology/Golden Gate Assembly

PCR samples used for sequencing were also used as template for molecular cloning. Gate Assembly (GGA) strategy used PCR to add compatible cloning ends. Briefly, GGA relies upon TypeII restriction enzymes to cut and seamlessly ligate together multiple DNA fragments. In this example, the multiple DNA fragments consisted of a synthetic nucleic acid sequence (gBlock, Integrated DNA Technologies, Coralville, IA) encoding signal, another gBlock encoding anti-GIPR variable domains; an antibody constant domain fragment released from a Parts vector; and the expression vector backbone. Table 9 breaks out these representative fragments.

TABLE 9

Fragments Assembled to create GLP1-GIPR Fusion Constructs

| Fragment | Expression units encoded by the Fragment |
|---|---|
| Part1 | Signal Peptide |
| PCR product | Variable domain of anti-GIPR antibody |
| Part2 | Constant domain corresponding to anti-GIPR variable domain |
| Vector | Desired Expression Vector |

The GGA reactions were composed of 10 ng of Part1, 10 ng of PCR product, 10 ng of the Part2, 10 ng of the expression vector, 1 μl 10×Fast Digest Reaction Buffer+0.5 mM ATP (Thermo Fisher, Waltham, MA), 0.5 μl FastDigest Esp3I (Thermo Fisher, Waltham, MA), 1 μl T4 DNA Ligase (5 U/μl, Thermo Fisher, Waltham, MA) and water to 10 μl. The reactions were performed over 15 cycles consisting of a 2 minute digestion step at 37° C. and a 3 minute ligation step at 16° C. The 15 cycles were followed by a final 5 minute 37° C. digestion step and a 5 minute enzyme inactivation step at 80° C. DNA amplification was done using chemically competent Top 10 cells (Invitrogen). Colonies were picked, grown in 2XYT media overnight at 37° C., and then DNA was extracted and purified using Turbo kits a QiaRobot (Qiagen). DNA was sequence confirmed prior to mammalian expression.

Mammalian Expression

The monoclonal antibodies were stably expressed in suspension adapted CHO-Kl cells with the corresponding cDNAs. Transfections were performed using Lipofectamine LTX (Thermo Fisher) according to the manufacturer's protocol. Briefly, a total of 2 μg of the mammalian expression plasmid DNA was used at a 1:1 heavy chain/light chain ratio. For each, the plasmid DNA was added to 0.5 ml OPTI-MEM (Thermo Fisher) and mixed. In a separate tubes, 10 μl Lipofectamine LTX was added to 0.5 ml OPTI-MEM. The solutions were incubated for 5 minutes at room temperature. To form the transfection complex, the DNA and Lipofectamine LTX mixtures for each were combined and incubated at room temperature for an additional 10 minutes.

Log phase CHO-Kl cells were pelleted by centrifugation (1200-1500 RPM for 5 minutes), washed one time with 1×PBS (Thermo Fisher) and resuspended to 1.5-2e6 viable cells/mL in OPTI-MEM. For each transfection, 1 mL of the washed cells were added to a transfection complex in a 24 deep well block. The plates were incubated at 36° C., 5% $CO_2$, shaking at 225 RPM for 6 hours. To stop the transfection, 2 ml growth media was added to each flask and incubated for 48 hours.

To begin selection, cells were pelleted by centrifugation (1200-1500 RPM for 5 minutes) 48 hours post-transfection and the media was replaced with 4 mL of growth media supplemented with antibiotics (puromycin 10 mg/L/hygromycin 600 mg/L). Selection media was changed 2-3 times per week, diluting cultures when needed to ensure cultures did not over-grow (<5-6 e6 vc/mL), until cell viability and density recovered.

Productions (100 mL) were carried out in shake flasks at 36° C. Productions were seeded at 2e6 vc/mL in production media. Conditioned media was harvested on day 7 by centrifugation followed by filtration (0.45 μm).

Purification

The molecules were purified from cell culture media using an AKTA Purifier (GE Healthcare Life Sciences, Little Chalfont, Buckinghamshire, UK) tandem liquid chromatography system with a 1 mL MabSelect SuRe (MSS) HiTrap (GE Healthcare Life Sciences) as the first column, and a 5 mL Desalting HiTrap (GE Healthcare Life Sciences) as the second column. The media was loaded directly onto the MSS column, then washed with 8 column volumes (CV) of 25 mM Tris-HCl, 100 mM NaCl, pH 7.4 and eluted with 2 CV of 100 mM acetic acid. The MSS column eluate was automatically channeled to the Desalting column where the protein was eluted isocratically over 4 CV of 10 mM Na-acetate, 150 mM NaCl, pH 5.2. The samples were sterile filtered through a 3.0 μm glass fiber/0.2 μm Supor membrane (Pall Corporation, Port Washington, New York, USA).

Protein Concentration Determination

The protein concentration of each purified molecule was determined by UV absorbance at 280 nm using a Multiskan GO microplate spectrophotometer (Thermo Fisher Scientific, Rockford, Illinois, USA).

Size Exclusion Chromatography Analysis

Samples were analyzed by size exclusion chromatography using an ACQUITY UPLC Protein BEH SEC column, 200 Å, 1.7 μm, 4.6×300 mm (Waters Corporation, Milford, Massachusetts, USA) running in 100 mM $NaH_2PO_4$, 50 mM NaCl, 7.5% ethanol, pH 6.9 at 0.4 mL/min observing the absorbance at 280 nm on a Waters ACQUITY UPLC system (Waters Corporation).

LCMS Methods

For reduced LCMS analysis, 20 μg of material was denatured in 8M guanidine HCl/TRIS pH 8.0 (Teknova, Hollister, CA), and reduced with 10 mM DTT (EMD Millipore, Darmstadt, Germany) at 50° C. for 20 minutes. The sample was acidified with trifluoroacetic acid, and 3 μg injected on a Waters BEH reverse phase C4 column using a Waters Acquity HPLC (Waters Corporation, Milford, MA). The column effluent was introduced to an electrospray source of a Xevo QTOF mass spectrometer (Waters Corporation, Milford, MA) and mass spectra were collected. Relevant spectra were deconvoluted using the MaxEnt algorithm within the Waters MassLynx software package. The resulting mass spectra for the LC and HC were compared to the theoretically calculated masses for each chain and denoted as pass/fail.

Tagg Methods:

Thermal aggregation onset temperatures were determined by running a Stepped Thermal Unfolding and Aggregation Study on the Avacta, Optim-1000. Data analysis and Tagg determination was preformed using Optim Analysis software (Igor version 6.31). Samples with concentrations greater than lmg/ml were normalized to 1.0 mg/ml in formulation buffer prior to Tagg analysis. Step thermal ramp was applied with start temperature 20° C. and stop temperature with 90° C. Temperature step was 1° C. and temperature hold time was 30 seconds. Exposure time was 500 ms with center wavelength 380 nm and slit with 250 μm.

cAMP Methods

Methods

This method is intended for the quantitative determination of cAMP in HEK 293T cells expressing the human GIPR or cynomolgus monkey GIPR. GIP binding causes GIPR conformation change, stimulating the G protein to active adenylate cyclase resulting in cAMP production from ATP. Antibody binding to GIPR prevents GIP binding to GIPR. This is measurable by a cAMP assay.

The cAMP assay is a HTRF immunoassay designed to measure cAMP produced upon modulation of adenylyl cyclase activity by GPCRs. The assay is based on the competition between native cAMP produced by the cells and the cAMP labeled with the dye d2 for binding sites on cAMP-specific monoclonal antibodies labeled with the Eu3+-Cryptate. When Eu3+-Cryptate conjugated antibodies are bound to the cAMP-d2 tracer, light pulse at 337 nm excites the Eu3+-Cryptate. The energy emitted by the excited Eu3+-Cryptate is transferred by FRET to d2 molecule on cAMP tracer, which in turn emits light at 665 nm. Residual energy from the Eu3+-Cryptate will produce light at 620 nm. In the absence of free cAMP, maximal HTRF signal is achieved. Free cAMP produced by stimulated cells competes with the cAMP-d2 tracer for the binding to the anti-cAMP Eu3+-Cryptate, causing a decrease in HTRF signal. The specific signal (i.e. energy transfer) is inversely proportional to the concentration of cAMP in the sample.

Experimental Design

Cells were maintained in DMEM, 10% FBS, 1× sodium pyruvate, lx Penicillin-Streptomycin-Glutamine, 2 to 5 μg/mL puromycin. Prior to experiments, cells were washed with DBPS, and dissociated with 0.5 mM EDTA in DPBS.

To establish a GIP response, a solution of GIP (in $H_2O$) was prepared and 3-fold serially diluted (Ham's F-12 with 0.1% BSA) and added to 30,000 recombinant cells in a 96 well black round bottomed plate. Cells were incubated in the presence of 0.5 mM IBMX at 5% CO2, 37° C. for 30 minutes. After incubation, 25 μL of d2-cAMP, and 25 μL of Eu3+-Cryptate-cAMP antibody were added, followed by incubation at room temperature for 1 hour. Wavelengths at 665 nm and 620 nm were measured using the EnVision Multilabel Reader and the ratio 665/620 ratio was calculated.

To establish a test article response, a solution of antibdody (10 mM sodium acetate, 9% sucrose, pH 5.2) was prepared and 3-fold serially diluted (Ham's F-12 with 0.1% BSA) and added to 30,000 recombinant cells in a 96 well black round bottomed plate and the cells were incubated at 5% CO2, 37° C. for 30 min. GIP was added to a final concentration of 50 pM. Cells were incubated in the presence of 0.5 mM IBMX at 5% $CO_2$, 37° C. for 30 minutes. After incubation, 25 μL of d2-cAMP, and 25 μL of Eu3+-Cryptate-cAMP antibody were added, followed by incubation at room temperature for 1 hour. Wavelengths at 665 nm and 620 nm were measured using the EnVision Multilabel Reader and the ratio 665/620 ratio was calculated.

Graphs were generated by plotting the concentration of GIP and antibody on the abscissa, against the average of the two replicate values for cAMP levels (665/620 ratio). The data points were then fit with a log (agonist) versus response—variable slope GraphPad Prism to give fit values for top, bottom, hill slope and both EC50 and IC50 (Table 10).

Verify GIPR Binding to Variants of 2G10 Affinity Maturation Hits Using BIAcore

Equipment, reagents and preparation of sensor chip surfaces:

Biacore T200, Biacore series S-CM5 sensor chip, amine coupling kit, surfactant P-20, 10 mM sodium acetate, pH4.0, and 10 mM glycine pH1.5 were from GE (Pittsburgh, PA). Phosphate-buffered saline (PBS, 1×, no calcium chloride, no magnesium chloride) was from Thermo Fisher Scientific (Waltham, MA). Bovine serum albumin (BSA, fraction V, IgG free) was from Sigma-Aldrich Corp. (St. Louis, MO). Goat-anti-huFc antibody was from Jackson ImmunoResearch Inc. (West Grove, PA).

Preparation of Sensor Chip Surfaces

Immobilization of Goat-anti-huFc antibody to a S-CM5 sensor chip surface was performed according to manufacturer's instructions. The Biacore instrument running buffer is 0.005% P20/PBS 1λ, pH7.4, no calcium chloride, no magnesium chloride. Briefly, carboxyl groups on the sensor chip surfaces were activated by injecting 60 μL of a mixture containing 0.2 M N-ethyl-N'-(dimethylaminopropyl) carbodiimide (EDC) and 0.05 M N-hydroxysuccinimide (NHS). Goat-anti-huFc antibody was diluted in 10 mM sodium acetate, pH 4.0 at 20 μg/ml and injected over the activated chip surface at 30 uL/min for 6 minutes. Excess reactive groups on the surfaces were deactivated by injecting 60 μL of 1 M ethanolamine. Final immobilized level was ~8000 resonance units (RU).

Binding assays were carried out on the immobilized goat anti-huFc antibody surface by Biacore T200. The experiment was performed at 25° C. The instrument running buffer was 0.005% P20/PBS. The goat anti-huFc capture antibody was covalently attached to the sensor chip surface via standard amine coupling to flow cells channel 1-4. The anti-huGIPR antibodies were diluted in sample buffer (0.1 mg/ml BSA, 0.005% P20, PBS) to ~10 nM then captured to flow cells channel 2, 3, 4. Flow cell channel 1 was as a blank reference surface without injection of anti-huGIPR antibody. The captured antibody response range was ~250 RU. Then 200 nM huGIPR ECD was injected over the goat anti-huFc antibody captured anti-huGIPR antibody surfaces at flow rate 50 ul/min for 3 minutes. After a 10 minutes dissociation, each surface was regenerated by injecting 10 mM Glycine, pH 1.5 for 30 seconds twice. The sensorgrams was analyzed using Biacore T200 evaluation software (v. 2.0). ks (1/s) for each antibody is shown in Table 10.

TABLE 10

Properties of affinity-matured anti-GIPR antibodies

| Antibody | PB CHOK1 titer mg/L | MSQC Score | Tagg ° C. | cAMP IC50 (nM) | lot amount (mg) | lot purity % | lot HMW % | ks (1/s) | Normalized Binding Response (Binding/ Capture RL) |
|---|---|---|---|---|---|---|---|---|---|
| 2G10.301 | 360 | PASS | 72.569° C. | 17.64 | 4.68 | 94.18 | 5.66 | 7E−05 | 0.22 |
| 2G10.302 | 299.2 | PASS | 69.672° C. | 19.92 | 3.89 | 94.37 | 7.2 | <5E−5 | 0.22 |
| 2G10.303 | 313.2 | PASS | 72.657° C. | 23.13 | 4.18 | 94.4 | 8.02 | 7E−05 | 0.23 |
| 2G10.304 | 283.5 | PASS | 72.796° C. | 16.93 | 3.32 | 94.96 | 6.7 | <5E−5 | 0.22 |
| 2G10.305 | 353.5 | PASS | 71.69° C. | 27.22 | 4.74 | 94.24 | 8.23 | <5E−5 | 0.24 |
| 2G10.306 | 358.1 | PASS | 70.206° C. | 20.74 | 4.33 | 94.52 | 6.09 | <5E−5 | 0.23 |
| 2G10.307 | 242.8 | PASS | 68.246° C. | 17.43 | 2.89 | 95.54 | 13.63 | 6E−05 | 0.21 |
| 2G10.308 | 360 | PASS | 71.285° C. | 18.27 | 4.32 | 94.56 | 7.52 | <5E−5 | 0.22 |
| 2G10.309 | 352.4 | PASS | 71.321° C. | 29.48 | 4.13 | 94.94 | 7.19 | <5E−5 | 0.23 |
| 2G10.311 | 292.6 | PASS | 65.478° C. | 14.86 | 3.87 | 83.6 | 5.14 | 6E−05 | 0.22 |
| 2G10.312 | 316.4 | PASS | 69.692° C. | 23.23 | 4.24 | 95.4 | 7.55 | <5E−5 | 0.23 |
| 2G10.313 | 302.5 | PASS | 71.541° C. | 20.7 | 3.76 | 95.48 | 6.5 | <5E−5 | 0.22 |
| 2G10.314 | 275.9 | PASS | 72.619° C. | 17.53 | 3.55 | 95.12 | 10.77 | 6E−05 | 0.22 |
| 2G10.315 | 332.1 | PASS | 68.86° C. | 22.02 | 4.05 | 94.47 | 6.66 | <5E−5 | 0.23 |
| 2G10.316 | 357 | PASS | 68.325° C. | 14.71 | 3.7 | 95.35 | 7.29 | <5E−5 | 0.22 |
| 2G10.317 | 338.5 | PASS | 67.887° C. | 13.66 | 3.6 | 95.81 | 4.77 | <5E−5 | 0.21 |
| 2G10.318 | 327.4 | PASS | 68.83° C. | 20.94 | 3.87 | 94.86 | 7.73 | <5E−5 | 0.22 |
| 2G10.319 | 123.2 | PASS | 66.392° C. | 7.903 | 1.46 | 92.18 | 21.17 | 6E−05 | 0.14 |
| 2G10.320 | 294.2 | PASS | 68.03° C. | 13.96 | 3.86 | 95.98 | 10.08 | <5E−5 | 0.23 |
| 2G10.321 | 111 | PASS | 66.459° C. | 7.461 | 1.05 | 90.06 | 22.53 | <5E−5 | 0.15 |
| 2G10.322 | 343.8 | PASS | 68.427° C. | 17.88 | 4.15 | 95.46 | 6.78 | 6E−05 | 0.22 |
| 2G10.323 | 271 | PASS | 70.608° C. | 17.45 | 3.25 | 94.06 | 9.6 | <5E−5 | 0.21 |
| 2G10.324 | 334.5 | PASS | 69.167° C. | 14.11 | 3.97 | 95.3 | 6.98 | <5E−5 | 0.24 |
| 2G10.325 | 360 | PASS | 67.573° C. | 26.22 | 4.3 | 93.95 | 4.72 | <5E−5 | 0.23 |
| 2G10.326 | 308.6 | PASS | 68.909° C. | 26.61 | 3.76 | 94.92 | 5.03 | 6E−05 | 0.23 |
| 2G10.327 | 328.7 | PASS | 68.819° C. | 19.26 | 4.06 | 93.28 | 10.64 | <5E−5 | 0.22 |
| 2G10.328 | 280.9 | PASS | 69.58° C. | 24.38 | 4.1 | 94.24 | 7.98 | 7E−05 | 0.24 |
| 2G10.329 | 306.2 | PASS | 68.346° C. | 26.79 | 4.45 | 94.19 | 8.27 | 6E−05 | 0.24 |
| 2G10.330 | 138.5 | PASS | 65.007° C. | 18.64 | 1.85 | 93.81 | 4.07 | <5E−5 | 0.21 |
| 2G10.331 | 360 | PASS | 70.325° C. | 19.68 | 5.17 | 93.93 | 7.95 | 5E−05 | 0.24 |
| 2G10.332 | 328 | PASS | 68.838° C. | 12.86 | 4.57 | 90.68 | 13.16 | 6E−05 | 0.21 |
| 2G10.333 | 349.5 | PASS | 66.902° C. | 12.07 | 4.04 | 94.97 | 7.48 | <5E−5 | 0.22 |
| 2G10.334 | 316.8 | PASS | 66.137° C. | 13.74 | 4.05 | 94.97 | 7.44 | 6E−05 | 0.23 |
| 2G10.335 | 243.2 | PASS | 66.531° C. | 25.91 | 3.99 | 94.15 | 7.07 | 6E−05 | 0.21 |
| 2G10.336 | 341.8 | PASS | 71.808° C. | 29.61 | 5.04 | 94.22 | 4.96 | 2E−04 | 0.24 |
| 2G10.337 | 238.2 | PASS | 69.706° C. | 32.53 | 4.53 | 95.38 | 7.77 | <5E−5 | 0.24 |
| 2G10.338 | 235.3 | PASS | 70.165° C. | 23.36 | 4.38 | 93.9 | 11.06 | 8E−05 | 0.22 |
| 2G10.339 | 315.5 | PASS | 70.224° C. | 22.61 | 4.27 | 95.39 | 4.9 | 7E−05 | 0.23 |
| 2G10.340 | 331.2 | PASS | 73.132° C. | 25.92 | 3.79 | 96.19 | 4.39 | 6E−05 | 0.23 |
| 2G10.341 | 360 | PASS | 67.97° C. | 24.74 | 5.23 | 95.03 | 8.5 | 7E−05 | 0.21 |
| 2G10.342 | 252.6 | PASS | 70.554° C. | 11.58 | 2.16 | 94.51 | 15.47 | <5E−5 | 0.16 |
| 2G10.343 | 289.5 | PASS | 70.649° C. | 37.61 | 4.99 | 94.75 | 5.07 | 6E−05 | 0.22 |
| 2G10.344 | 266.3 | PASS | 70.783° C. | 21.9 | 4.84 | 95.43 | 5.63 | 6E−05 | 0.22 |
| 2G10.345 | 151.8 | PASS | 68.885° C. | 18.85 | 2.75 | 94.93 | 14.09 | 8E−05 | 0.19 |
| 2G10.346 | 315.8 | PASS | 69.926° C. | 22.25 | 5.11 | 95.25 | 5.13 | 1E−04 | 0.23 |
| 2G10.347 | 332.4 | PASS | 68.252° C. | 28.41 | 4.56 | 95.73 | 7.47 | 1E−04 | 0.24 |
| 2G10.348 | 353.6 | PASS | 70.752° C. | 42.8 | 5.55 | 96.06 | 8.17 | 6E−04 | 0.24 |
| 2G10.601 | 350.9 | PASS | 70.55° C. | 21.45 | 4.75 | 94.78 | 5.76 | 6E−05 | 0.23 |
| 2G10.602 | 252.3 | PASS | 67.651° C. | 16.81 | 4.06 | 95.53 | 6.63 | <5E−5 | 0.23 |
| 2G10.603 | 232.7 | PASS | 71.14° C. | 30.51 | 4.33 | 95.75 | 7.43 | <5E−5 | 0.23 |
| 2G10.604 | 246.9 | PASS | 70.673° C. | 27.07 | 4.18 | 95.9 | 7.2 | <5E−5 | 0.23 |
| 2G10.605 | 250.7 | PASS | 67.318° C. | 25.62 | 4.49 | 96.13 | 7.57 | 7E−05 | 0.24 |
| 2G10.606 | 224.6 | PASS | 70.046° C. | 20.36 | 3.95 | 95.86 | 5.33 | <5E−5 | 0.23 |
| 2G10.607 | 251.7 | PASS | 66.65° C. | 19.38 | 3.08 | 96.45 | 15.36 | 6E−05 | 0.21 |
| 2G10.608 | 360 | PASS | 69.596° C. | 21.67 | 4.55 | 95.01 | 7.79 | <5E−5 | 0.22 |
| 2G10.609 | 353.7 | PASS | 70.855° C. | 26.93 | 5.14 | 95.74 | 7.75 | 6E−05 | 0.23 |
| 2G10.610 | 307 | PASS | 69.433° C. | 12.94 | 4.5 | 94.84 | 7.87 | <5E−5 | 0.22 |

Antibody 2G10.248 was further affinity matured, resulting in antibodies iPS:529381, iPS:529382, iPS:529397, iPS:529399, iPS:529400, iPS:529403, iPS:529404, and iPS:529405. These antibodies all contain the half-life extending YTE mutations at positions M252 (M252Y), S254 (S254T), and T256 (T256E) of the heavy chain. In addition, antibodies iPS:529397, iPS:529399, iPS:529400, iPS:529403, iPS:529404, and iPS:529405 all also contain the viscosity reducing mutations M4L, V13L, A76D, S95S, Q97E, S98P in the light chain.

| Identifier | Visc. Mut. | HLE-YTE | Tm1 | Tagg | IC50 (nM) | human cAMP IC50 (nM) | murine cAMP (nM) |
|---|---|---|---|---|---|---|---|
| 2G10.348 | None | none | 76.2 | 100 | 18.3 | 53 | 14600 |
| iPS:529381 | None | YTE | 77.7 | 77.5 | 13.7 | 33.2 | 9.3 |
| iPS:529382 | None | YTE | 77.8 | 78.8 | 12.1 | 26.2 | 49.7 |
| iPS:529397 | +VM | YTE | 75.5 | 76 | 35.6 | 50 | 108 |
| iPS:529399 | +VM | YTE | 77.7 | 76.8 | 20.2 | 39.3 | 12.9 |

-continued

| Identifier | Visc. Mut. | HLE-YTE | Tm1 | Tagg | IC50 (nM) | human cAMP IC50 (nM) | murine cAMP (nM) |
|---|---|---|---|---|---|---|---|
| iPS:529400 | +VM | YTE | 77.9 | 78 | 17.5 | 36.6 | 79.5 |
| iPS:529403 | +VM | YTE | 77.4 | 76.2 | 22.5 | 33.9 | 12 |

-continued

| Identifier | Visc. Mut. | HLE-YTE | Tm1 | Tagg | IC50 (nM) | human cAMP IC50 (nM) | murine cAMP (nM) |
|---|---|---|---|---|---|---|---|
| iPS:529404 | +VM | YTE | 76.4 | 76.3 | 18.1 | 27.8 | 3.9 |
| iPS:529405 | +VM | YTE | 69 | 73.5 | 15.1 | 22.7 | 6.1 |

SEQUENCE LISTING (1399 sequences)

SEQ ID NO: 1 - DNA, 33 bp, Artificial Sequence
  source: /note="Description of Artificial Sequence: Synthetic oligonucleotide"
agggccagtcagagtgttgatagacacttagcc

SEQ ID NO: 2 - DNA, 21 bp, Artificial Sequence
  source: /note="Description of Artificial Sequence: Synthetic oligonucleotide"
gaagcagccaccagggccact

SEQ ID NO: 3 - DNA, 27 bp, Artificial Sequence
  source: /note="Description of Artificial Sequence: Synthetic oligonucleotide"
cagcagtatcagaactggcctctcact

SEQ ID NO: 4 - protein, 11 aa, Artificial Sequence
  source: /note="Description of Artificial Sequence: Synthetic peptide"
RASQSVDRHLA

SEQ ID NO: 5 - protein, 7 aa, Artificial Sequence
  source: /note="Description of Artificial Sequence: Synthetic peptide"
EAATRAT

SEQ ID NO: 6 - protein, 9 aa, Artificial Sequence
  source: /note="Description of Artificial Sequence: Synthetic peptide"
QQYQNWPLT

SEQ ID NO: 7 - DNA, 33 bp, Artificial Sequence
  source: /note="Description of Artificial Sequence: Synthetic oligonucleotide"
agggccagtcagagtgttaacagacacttagcc

SEQ ID NO: 8 - DNA, 21 bp, Artificial Sequence
  source: /note="Description of Artificial Sequence: Synthetic oligonucleotide"
gaagcagccaccagggccact

SEQ ID NO: 9 - DNA, 27 bp, Artificial Sequence
  source: /note="Description of Artificial Sequence: Synthetic oligonucleotide"
cagcagtatcagaactggcctctcact

SEQ ID NO: 10 - protein, 11 aa, Artificial Sequence
  source: /note="Description of Artificial Sequence: Synthetic peptide"
RASQSVNRHLA

SEQ ID NO: 11 - protein, 7 aa, Artificial Sequence
  source: /note="Description of Artificial Sequence: Synthetic peptide"
EAATRAT

SEQ ID NO: 12 - protein, 9 aa, Artificial Sequence
  source: /note="Description of Artificial Sequence: Synthetic peptide"
QQYQNWPLT

SEQ ID NO: 13 - DNA, 33 bp, Artificial Sequence
  source: /note="Description of Artificial Sequence: Synthetic oligonucleotide"
agggccagtcagagtgttcatagacacttagcc

SEQ ID NO: 14 - DNA, 21 bp, Artificial Sequence
  source: /note="Description of Artificial Sequence: Synthetic oligonucleotide"
gaagcagccaccagggccact

SEQ ID NO: 15 - DNA, 27 bp, Artificial Sequence
  source: /note="Description of Artificial Sequence: Synthetic oligonucleotide"
cagcagtatcagaactggcctctcact

SEQ ID NO: 16 - protein, 11 aa, Artificial Sequence
  source: /note="Description of Artificial Sequence: Synthetic peptide"
RASQSVHRHLA

SEQ ID NO: 17 - protein, 7 aa, Artificial Sequence
  source: /note="Description of Artificial Sequence: Synthetic peptide"
EAATRAT

SEQ ID NO: 18 - protein, 9 aa, Artificial Sequence
  source: /note="Description of Artificial Sequence: Synthetic peptide"
QQYQNWPLT

SEQ ID NO: 19 - DNA, 33 bp, Artificial Sequence
  source: /note="Description of Artificial Sequence: Synthetic oligonucleotide"
agggccagtcagagtgttgaaagacacttagcc

SEQ ID NO: 20 - DNA, 21 bp, Artificial Sequence
  source: /note="Description of Artificial Sequence: Synthetic oligonucleotide"
gaagcagccaccagggccact

SEQ ID NO: 21 - DNA, 27 bp, Artificial Sequence
  source: /note="Description of Artificial Sequence: Synthetic oligonucleotide"
cagcagtatcagaactggcctctcact

SEQ ID NO: 22 - protein, 11 aa, Artificial Sequence
  source: /note="Description of Artificial Sequence: Synthetic peptide"
RASQSVERHLA

SEQ ID NO: 23 - protein, 7 aa, Artificial Sequence
  source: /note="Description of Artificial Sequence: Synthetic peptide"
EAATRAT

SEQ ID NO: 24 - protein, 9 aa, Artificial Sequence
  source: /note="Description of Artificial Sequence: Synthetic peptide"
QQYQNWPLT

SEQ ID NO: 25 - DNA, 33 bp, Artificial Sequence
  source: /note="Description of Artificial Sequence: Synthetic oligonucleotide"
agggccagtcagagtgttttcagacacttagcc

SEQ ID NO: 26 - DNA, 21 bp, Artificial Sequence
  source: /note="Description of Artificial Sequence: Synthetic oligonucleotide"
gaagcagccaccagggccact

SEQ ID NO: 27 - DNA, 27 bp, Artificial Sequence
  source: /note="Description of Artificial Sequence: Synthetic oligonucleotide"
cagcagtatcagaactggcctctcact

SEQ ID NO: 28 - protein, 11 aa, Artificial Sequence
  source: /note="Description of Artificial Sequence: Synthetic peptide"
RASQSVFRHLA

SEQ ID NO: 29 - protein, 7 aa, Artificial Sequence
  source: /note="Description of Artificial Sequence: Synthetic peptide"
EAATRAT

SEQ ID NO: 30 - protein, 9 aa, Artificial Sequence
  source: /note="Description of Artificial Sequence: Synthetic peptide"
QQYQNWPLT

SEQ ID NO: 31 - DNA, 33 bp, Artificial Sequence; identical to SEQ ID NO: 7
  source: /note="Description of Artificial Sequence: Synthetic oligonucleotide"

SEQ ID NO: 32 - DNA, 21 bp, Artificial Sequence
  source: /note="Description of Artificial Sequence: Synthetic oligonucleotide"
gaagcagccaccagggccact

SEQ ID NO: 33 - DNA, 27 bp, Artificial Sequence
  source: /note="Description of Artificial Sequence: Synthetic oligonucleotide"
cagcagtatcagaactggcctctcact

SEQ ID NO: 34 - protein, 11 aa, Artificial Sequence
  source: /note="Description of Artificial Sequence: Synthetic peptide"
RASQSVNRHLA

SEQ ID NO: 35 - protein, 7 aa, Artificial Sequence
  source: /note="Description of Artificial Sequence: Synthetic peptide"
EAATRAT

SEQ ID NO: 36 - protein, 9 aa, Artificial Sequence
  source: /note="Description of Artificial Sequence: Synthetic peptide"
QQYQNWPLT

SEQ ID NO: 37 - DNA, 33 bp, Artificial Sequence; identical to SEQ ID NO: 19
  source: /note="Description of Artificial Sequence: Synthetic oligonucleotide"

SEQ ID NO: 38 - DNA, 21 bp, Artificial Sequence
  source: /note="Description of Artificial Sequence: Synthetic oligonucleotide"
gaagcagccaccagggccact

SEQ ID NO: 39 - DNA, 27 bp, Artificial Sequence
  source: /note="Description of Artificial Sequence: Synthetic oligonucleotide"
cagcagtatcagaactggcctctcact

SEQ ID NO: 40 - protein, 11 aa, Artificial Sequence
  source: /note="Description of Artificial Sequence: Synthetic peptide"
RASQSVERHLA

SEQ ID NO: 41 - protein, 7 aa, Artificial Sequence
  source: /note="Description of Artificial Sequence: Synthetic peptide"
EAATRAT

SEQ ID NO: 42 - protein, 9 aa, Artificial Sequence
  source: /note="Description of Artificial Sequence: Synthetic peptide"
QQYQNWPLT

SEQ ID NO: 43 - DNA, 33 bp, Artificial Sequence; identical to SEQ ID NO: 1
  source: /note="Description of Artificial Sequence: Synthetic oligonucleotide"

SEQ ID NO: 44 - DNA, 21 bp, Artificial Sequence
  source: /note="Description of Artificial Sequence: Synthetic oligonucleotide"
gaagcagccaccagggccact

SEQ ID NO: 45 - DNA, 27 bp, Artificial Sequence
  source: /note="Description of Artificial Sequence: Synthetic oligonucleotide"
cagcagtatcagaactggcctctcact

SEQ ID NO: 46 - protein, 11 aa, Artificial Sequence
  source: /note="Description of Artificial Sequence: Synthetic peptide"
RASQSVDRHLA

SEQ ID NO: 47 - protein, 7 aa, Artificial Sequence
  source: /note="Description of Artificial Sequence: Synthetic peptide"
EAATRAT

SEQ ID NO: 48 - protein, 9 aa, Artificial Sequence
  source: /note="Description of Artificial Sequence: Synthetic peptide"
QQYQNWPLT

SEQ ID NO: 49 - DNA, 33 bp, Artificial Sequence
  source: /note="Description of Artificial Sequence: Synthetic oligonucleotide"
agggccagtcagagtgttctgagtcacttagcc

SEQ ID NO: 50 - DNA, 21 bp, Artificial Sequence
  source: /note="Description of Artificial Sequence: Synthetic oligonucleotide"
gaagcagccaccagggccact

SEQ ID NO: 51 - DNA, 27 bp, Artificial Sequence
  source: /note="Description of Artificial Sequence: Synthetic oligonucleotide"
cagcagtataacaactggcctctcact

SEQ ID NO: 52 - protein, 11 aa, Artificial Sequence
  source: /note="Description of Artificial Sequence: Synthetic peptide"
RASQSVLSHLA

SEQ ID NO: 53 - protein, 7 aa, Artificial Sequence
  source: /note="Description of Artificial Sequence: Synthetic peptide"
EAATRAT

SEQ ID NO: 54 - protein, 9 aa, Artificial Sequence
  source: /note="Description of Artificial Sequence: Synthetic peptide"
QQYNNWPLT

SEQ ID NO: 55 - DNA, 33 bp, Artificial Sequence; identical to SEQ ID NO: 49
  source: /note="Description of Artificial Sequence: Synthetic oligonucleotide"

SEQ ID NO: 56 - DNA, 21 bp, Artificial Sequence
  source: /note="Description of Artificial Sequence: Synthetic oligonucleotide"
gaagcagccaccagggccact

SEQ ID NO: 57 - DNA, 27 bp, Artificial Sequence
  source: /note="Description of Artificial Sequence: Synthetic oligonucleotide"
cagcagtatcagaactggcctctcact

SEQ ID NO: 58 - protein, 11 aa, Artificial Sequence
  source: /note="Description of Artificial Sequence: Synthetic peptide"
RASQSVLSHLA

SEQ ID NO: 59 - protein, 7 aa, Artificial Sequence
  source: /note="Description of Artificial Sequence: Synthetic peptide"
EAATRAT

SEQ ID NO: 60 - protein, 9 aa, Artificial Sequence
  source: /note="Description of Artificial Sequence: Synthetic peptide"
QQYQNWPLT

SEQ ID NO: 61 - DNA, 33 bp, Artificial Sequence
  source: /note="Description of Artificial Sequence: Synthetic oligonucleotide"
agggccagtcagagtgttatgagtcacttagcc

SEQ ID NO: 62 - DNA, 21 bp, Artificial Sequence
  source: /note="Description of Artificial Sequence: Synthetic oligonucleotide"
gaagcagccaccagggccact

SEQ ID NO: 63 - DNA, 27 bp, Artificial Sequence
  source: /note="Description of Artificial Sequence: Synthetic oligonucleotide"
cagcagtatcagaactggcctctcact

SEQ ID NO: 64 - protein, 11 aa, Artificial Sequence
  source: /note="Description of Artificial Sequence: Synthetic peptide"
RASQSVMSHLA

SEQ ID NO: 65 - protein, 7 aa, Artificial Sequence
  source: /note="Description of Artificial Sequence: Synthetic peptide"
EAATRAT

SEQ ID NO: 66 - protein, 9 aa, Artificial Sequence
  source: /note="Description of Artificial Sequence: Synthetic peptide"
QQYQNWPLT

SEQ ID NO: 67 - DNA, 33 bp, Artificial Sequence
  source: /note="Description of Artificial Sequence: Synthetic oligonucleotide"
agggccagtcagagtgttctgacgcacttagcc

SEQ ID NO: 68 - DNA, 21 bp, Artificial Sequence
  source: /note="Description of Artificial Sequence: Synthetic oligonucleotide"
gaagcagccaccagggccact

SEQ ID NO: 69 - DNA, 27 bp, Artificial Sequence
  source: /note="Description of Artificial Sequence: Synthetic oligonucleotide"
cagcagtatcagaactggcctctcact

SEQ ID NO: 70 - protein, 11 aa, Artificial Sequence
  source: /note="Description of Artificial Sequence: Synthetic peptide"
RASQSVLTHLA

SEQ ID NO: 71 - protein, 7 aa, Artificial Sequence
  source: /note="Description of Artificial Sequence: Synthetic peptide"
EAATRAT

SEQ ID NO: 72 - protein, 9 aa, Artificial Sequence
  source: /note="Description of Artificial Sequence: Synthetic peptide"
QQYQNWPLT

SEQ ID NO: 73 - DNA, 33 bp, Artificial Sequence
  source: /note="Description of Artificial Sequence: Synthetic oligonucleotide"
agggccagtcagagtgttgatctgcacttagcc

SEQ ID NO: 74 - DNA, 21 bp, Artificial Sequence
  source: /note="Description of Artificial Sequence: Synthetic oligonucleotide"
gaagcagccaccagggccact

SEQ ID NO: 75 - DNA, 27 bp, Artificial Sequence
  source: /note="Description of Artificial Sequence: Synthetic oligonucleotide"
cagcagtatcagaactggcctctcact

SEQ ID NO: 76 - protein, 11 aa, Artificial Sequence
  source: /note="Description of Artificial Sequence: Synthetic peptide"
RASQSVDLHLA

SEQ ID NO: 77 - protein, 7 aa, Artificial Sequence
  source: /note="Description of Artificial Sequence: Synthetic peptide"
EAATRAT

SEQ ID NO: 78 - protein, 9 aa, Artificial Sequence
  source: /note="Description of Artificial Sequence: Synthetic peptide"
QQYQNWPLT

SEQ ID NO: 79 - DNA, 33 bp, Artificial Sequence
  source: /note="Description of Artificial Sequence: Synthetic oligonucleotide"
agggccagtcagagtgttagcgaacacttagcc

SEQ ID NO: 80 - DNA, 21 bp, Artificial Sequence
  source: /note="Description of Artificial Sequence: Synthetic oligonucleotide"
gaagcagccaccagggccact

SEQ ID NO: 81 - DNA, 27 bp, Artificial Sequence
  source: /note="Description of Artificial Sequence: Synthetic oligonucleotide"
cagcagtatcagaactggcctctcact

SEQ ID NO: 82 - protein, 11 aa, Artificial Sequence
  source: /note="Description of Artificial Sequence: Synthetic peptide"
RASQSVSEHLA

SEQ ID NO: 83 - protein, 7 aa, Artificial Sequence
  source: /note="Description of Artificial Sequence: Synthetic peptide"
EAATRAT

SEQ ID NO: 84 - protein, 9 aa, Artificial Sequence
  source: /note="Description of Artificial Sequence: Synthetic peptide"
QQYQNWPLT

SEQ ID NO: 85 - DNA, 33 bp, Artificial Sequence; identical to SEQ ID NO: 79
  source: /note="Description of Artificial Sequence: Synthetic oligonucleotide"

SEQ ID NO: 86 - DNA, 21 bp, Artificial Sequence
  source: /note="Description of Artificial Sequence: Synthetic oligonucleotide"
gaagcagccaccagggccact

SEQ ID NO: 87 - DNA, 27 bp, Artificial Sequence
  source: /note="Description of Artificial Sequence: Synthetic oligonucleotide"
cagcagtatcagaactggcctctcact

SEQ ID NO: 88 - protein, 11 aa, Artificial Sequence
  source: /note="Description of Artificial Sequence: Synthetic peptide"
RASQSVSEHLA

SEQ ID NO: 89 - protein, 7 aa, Artificial Sequence
  source: /note="Description of Artificial Sequence: Synthetic peptide"
EAATRAT

SEQ ID NO: 90 - protein, 9 aa, Artificial Sequence
  source: /note="Description of Artificial Sequence: Synthetic peptide"
QQYQNWPLT

SEQ ID NO: 91 - DNA, 33 bp, Artificial Sequence
  source: /note="Description of Artificial Sequence: Synthetic oligonucleotide"
agggccagtcagagtgttagccggcacttagcc

SEQ ID NO: 92 - DNA, 21 bp, Artificial Sequence
  source: /note="Description of Artificial Sequence: Synthetic oligonucleotide"
gaagcagccaccagggccact

SEQ ID NO: 93 - DNA, 27 bp, Artificial Sequence
  source: /note="Description of Artificial Sequence: Synthetic oligonucleotide"
cagcagtatcagcactggcctctcact

SEQ ID NO: 94 - protein, 11 aa, Artificial Sequence
  source: /note="Description of Artificial Sequence: Synthetic peptide"
RASQSVSRHLA

SEQ ID NO: 95 - protein, 7 aa, Artificial Sequence
  source: /note="Description of Artificial Sequence: Synthetic peptide"
EAATRAT

SEQ ID NO: 96 - protein, 9 aa, Artificial Sequence
  source: /note="Description of Artificial Sequence: Synthetic peptide"
QQYQHWPLT

SEQ ID NO: 97 - DNA, 33 bp, Artificial Sequence
  source: /note="Description of Artificial Sequence: Synthetic oligonucleotide"
agggccagtcagagtgttttcagccacttagcc

SEQ ID NO: 98 - DNA, 21 bp, Artificial Sequence
  source: /note="Description of Artificial Sequence: Synthetic oligonucleotide"
gaagcagccaccagggccact

SEQ ID NO: 99 - DNA, 27 bp, Artificial Sequence
  source: /note="Description of Artificial Sequence: Synthetic oligonucleotide"
cagcagtatcagaactggcctctcact

SEQ ID NO: 100 - protein, 11 aa, Artificial Sequence
  source: /note="Description of Artificial Sequence: Synthetic peptide"
RASQSVFSHLA

SEQ ID NO: 101 - protein, 7 aa, Artificial Sequence
  source: /note="Description of Artificial Sequence: Synthetic peptide"
EAATRAT

SEQ ID NO: 102 - protein, 9 aa, Artificial Sequence
  source: /note="Description of Artificial Sequence: Synthetic peptide"
QQYQNWPLT

SEQ ID NO: 103 - DNA, 33 bp, Artificial Sequence; identical to SEQ ID NO: 97
  source: /note="Description of Artificial Sequence: Synthetic oligonucleotide"

SEQ ID NO: 104 - DNA, 21 bp, Artificial Sequence
  source: /note="Description of Artificial Sequence: Synthetic oligonucleotide"
gaagcagccaccagggccact

SEQ ID NO: 105 - DNA, 27 bp, Artificial Sequence
  source: /note="Description of Artificial Sequence: Synthetic oligonucleotide"
cagcagtatcagaactggcctctcact

SEQ ID NO: 106 - protein, 11 aa, Artificial Sequence
  source: /note="Description of Artificial Sequence: Synthetic peptide"
RASQSVFSHLA

SEQ ID NO: 107 - protein, 7 aa, Artificial Sequence
  source: /note="Description of Artificial Sequence: Synthetic peptide"
EAATRAT

SEQ ID NO: 108 - protein, 9 aa, Artificial Sequence
  source: /note="Description of Artificial Sequence: Synthetic peptide"
QQYQNWPLT

SEQ ID NO: 109 - DNA, 33 bp, Artificial Sequence; identical to SEQ ID NO: 49
  source: /note="Description of Artificial Sequence: Synthetic oligonucleotide"

SEQ ID NO: 110 - DNA, 21 bp, Artificial Sequence
  source: /note="Description of Artificial Sequence: Synthetic oligonucleotide"
gaagcagccaccagggccact

SEQ ID NO: 111 - DNA, 27 bp, Artificial Sequence
  source: /note="Description of Artificial Sequence: Synthetic oligonucleotide"
cagcagtatcagcagtggcctctcact

SEQ ID NO: 112 - protein, 11 aa, Artificial Sequence
  source: /note="Description of Artificial Sequence: Synthetic peptide"
RASQSVLSHLA

SEQ ID NO: 113 - protein, 7 aa, Artificial Sequence
  source: /note="Description of Artificial Sequence: Synthetic peptide"
EAATRAT

SEQ ID NO: 114 - protein, 9 aa, Artificial Sequence
  source: /note="Description of Artificial Sequence: Synthetic peptide"
QQYQQWPLT

SEQ ID NO: 115 - DNA, 33 bp, Artificial Sequence; identical to SEQ ID NO: 97
  source: /note="Description of Artificial Sequence: Synthetic oligonucleotide"

SEQ ID NO: 116 - DNA, 21 bp, Artificial Sequence
  source: /note="Description of Artificial Sequence: Synthetic oligonucleotide"
gaagcagccaccagggccact

SEQ ID NO: 117 - DNA, 27 bp, Artificial Sequence
  source: /note="Description of Artificial Sequence: Synthetic oligonucleotide"
cagcagtatcagcagtggcctctcact

SEQ ID NO: 118 - protein, 11 aa, Artificial Sequence
  source: /note="Description of Artificial Sequence: Synthetic peptide"
RASQSVFSHLA

SEQ ID NO: 119 - protein, 7 aa, Artificial Sequence
  source: /note="Description of Artificial Sequence: Synthetic peptide"
EAATRAT

SEQ ID NO: 120 - protein, 9 aa, Artificial Sequence
  source: /note="Description of Artificial Sequence: Synthetic peptide"
QQYQQWPLT

SEQ ID NO: 121 - DNA, 33 bp, Artificial Sequence; identical to SEQ ID NO: 97
  source: /note="Description of Artificial Sequence: Synthetic oligonucleotide"

SEQ ID NO: 122 - DNA, 21 bp, Artificial Sequence
  source: /note="Description of Artificial Sequence: Synthetic oligonucleotide"
gaagcagccaccagggccact

SEQ ID NO: 123 - DNA, 27 bp, Artificial Sequence
  source: /note="Description of Artificial Sequence: Synthetic oligonucleotide"
cagcagtatcagcagtggcctctcact

SEQ ID NO: 124 - protein, 11 aa, Artificial Sequence
  source: /note="Description of Artificial Sequence: Synthetic peptide"
RASQSVFSHLA

SEQ ID NO: 125 - protein, 7 aa, Artificial Sequence
  source: /note="Description of Artificial Sequence: Synthetic peptide"
EAATRAT

SEQ ID NO: 126 - protein, 9 aa, Artificial Sequence
  source: /note="Description of Artificial Sequence: Synthetic peptide"
QQYQQWPLT

SEQ ID NO: 127 - DNA, 33 bp, Artificial Sequence
  source: /note="Description of Artificial Sequence: Synthetic oligonucleotide"
agggccagtcagagtgttcagagccacttagcc

SEQ ID NO: 128 - DNA, 21 bp, Artificial Sequence
  source: /note="Description of Artificial Sequence: Synthetic oligonucleotide"
gaagcagccaccagggccact

SEQ ID NO: 129 - DNA, 27 bp, Artificial Sequence
  source: /note="Description of Artificial Sequence: Synthetic oligonucleotide"
cagcagtatcagaactggcctctcact

SEQ ID NO: 130 - protein, 11 aa, Artificial Sequence
  source: /note="Description of Artificial Sequence: Synthetic peptide"
RASQSVQSHLA

SEQ ID NO: 131 - protein, 7 aa, Artificial Sequence
  source: /note="Description of Artificial Sequence: Synthetic peptide"
EAATRAT

SEQ ID NO: 132 - protein, 9 aa, Artificial Sequence
  source: /note="Description of Artificial Sequence: Synthetic peptide"
QQYQNWPLT

SEQ ID NO: 133 - DNA, 33 bp, Artificial Sequence
  source: /note="Description of Artificial Sequence: Synthetic oligonucleotide"
agggccagtcagagtgttagtagccacttagcc

SEQ ID NO: 134 - DNA, 21 bp, Artificial Sequence
  source: /note="Description of Artificial Sequence: Synthetic oligonucleotide"
gaagcagccaccagggccact

SEQ ID NO: 135 - DNA, 27 bp, Artificial Sequence
  source: /note="Description of Artificial Sequence: Synthetic oligonucleotide"
cagcagtatcagcagtggcctctcact

SEQ ID NO: 136 - protein, 11 aa, Artificial Sequence
  source: /note="Description of Artificial Sequence: Synthetic peptide"
RASQSVSSHLA

SEQ ID NO: 137 - protein, 7 aa, Artificial Sequence
  source: /note="Description of Artificial Sequence: Synthetic peptide"
EAATRAT

SEQ ID NO: 138 - protein, 9 aa, Artificial Sequence
  source: /note="Description of Artificial Sequence: Synthetic peptide"
QQYQQWPLT

SEQ ID NO: 139 - DNA, 33 bp, Artificial Sequence
  source: /note="Description of Artificial Sequence: Synthetic oligonucleotide"
agggccagtcagagtgttttcacgcacttagcc

SEQ ID NO: 140 - DNA, 21 bp, Artificial Sequence
  source: /note="Description of Artificial Sequence: Synthetic oligonucleotide"
gaagcagccaccagggccact

SEQ ID NO: 141 - DNA, 27 bp, Artificial Sequence
  source: /note="Description of Artificial Sequence: Synthetic oligonucleotide"
cagcagtataacaactggcctctcact

SEQ ID NO: 142 - protein, 11 aa, Artificial Sequence
  source: /note="Description of Artificial Sequence: Synthetic peptide"
RASQSVFTHLA

SEQ ID NO: 143 - protein, 7 aa, Artificial Sequence
  source: /note="Description of Artificial Sequence: Synthetic peptide"
EAATRAT

SEQ ID NO: 144 - protein, 9 aa, Artificial Sequence
  source: /note="Description of Artificial Sequence: Synthetic peptide"
QQYNNWPLT

SEQ ID NO: 145 - DNA, 33 bp, Artificial Sequence; identical to SEQ ID NO: 139
  source: /note="Description of Artificial Sequence: Synthetic oligonucleotide"

SEQ ID NO: 146 - DNA, 21 bp, Artificial Sequence
  source: /note="Description of Artificial Sequence: Synthetic oligonucleotide"
gaagcagccaccagggccact

SEQ ID NO: 147 - DNA, 27 bp, Artificial Sequence
  source: /note="Description of Artificial Sequence: Synthetic oligonucleotide"
cagcagtataacaactggcctctcact

SEQ ID NO: 148 - protein, 11 aa, Artificial Sequence
  source: /note="Description of Artificial Sequence: Synthetic peptide"
RASQSVFTHLA

SEQ ID NO: 149 - protein, 7 aa, Artificial Sequence
  source: /note="Description of Artificial Sequence: Synthetic peptide"
EAATRAT

SEQ ID NO: 150 - protein, 9 aa, Artificial Sequence
  source: /note="Description of Artificial Sequence: Synthetic peptide"
QQYNNWPLT

SEQ ID NO: 151 - DNA, 33 bp, Artificial Sequence
  source: /note="Description of Artificial Sequence: Synthetic oligonucleotide"
agggccagtcagagtgtttttgaacacttagcc

SEQ ID NO: 152 - DNA, 21 bp, Artificial Sequence
  source: /note="Description of Artificial Sequence: Synthetic oligonucleotide"
gaagcagccaccagggccact

SEQ ID NO: 153 - DNA, 27 bp, Artificial Sequence
  source: /note="Description of Artificial Sequence: Synthetic oligonucleotide"
cagcagtataacaactggcctctcact

SEQ ID NO: 154 - protein, 11 aa, Artificial Sequence
  source: /note="Description of Artificial Sequence: Synthetic peptide"
RASQSVFEHLA

SEQ ID NO: 155 - protein, 7 aa, Artificial Sequence
  source: /note="Description of Artificial Sequence: Synthetic peptide"
EAATRAT

SEQ ID NO: 156 - protein, 9 aa, Artificial Sequence
  source: /note="Description of Artificial Sequence: Synthetic peptide"
QQYNNWPLT

SEQ ID NO: 157 - DNA, 33 bp, Artificial Sequence
  source: /note="Description of Artificial Sequence: Synthetic oligonucleotide"
agggccagtcagagtgttgaacagcacttagcc

SEQ ID NO: 158 - DNA, 21 bp, Artificial Sequence
  source: /note="Description of Artificial Sequence: Synthetic oligonucleotide"
gaagcagccaccagggccact

SEQ ID NO: 159 - DNA, 27 bp, Artificial Sequence
  source: /note="Description of Artificial Sequence: Synthetic oligonucleotide"
cagcagtataacaactggcctctcact

SEQ ID NO: 160 - protein, 11 aa, Artificial Sequence
  source: /note="Description of Artificial Sequence: Synthetic peptide"
RASQSVEQHLA

SEQ ID NO: 161 - protein, 7 aa, Artificial Sequence
  source: /note="Description of Artificial Sequence: Synthetic peptide"
EAATRAT

SEQ ID NO: 162 - protein, 9 aa, Artificial Sequence
  source: /note="Description of Artificial Sequence: Synthetic peptide"
QQYNNWPLT

SEQ ID NO: 163 - DNA, 33 bp, Artificial Sequence
  source: /note="Description of Artificial Sequence: Synthetic oligonucleotide"
agggccagtcagagtgttcatagccacttagcc

SEQ ID NO: 164 - DNA, 21 bp, Artificial Sequence
  source: /note="Description of Artificial Sequence: Synthetic oligonucleotide"
gaagcagccaccagggccact

SEQ ID NO: 165 - DNA, 27 bp, Artificial Sequence
  source: /note="Description of Artificial Sequence: Synthetic oligonucleotide"
cagcagtataaccagtggcctctcact

SEQ ID NO: 166 - protein, 11 aa, Artificial Sequence
  source: /note="Description of Artificial Sequence: Synthetic peptide"
RASQSVHSHLA

SEQ ID NO: 167 - protein, 7 aa, Artificial Sequence
  source: /note="Description of Artificial Sequence: Synthetic peptide"
EAATRAT

SEQ ID NO: 168 - protein, 9 aa, Artificial Sequence
  source: /note="Description of Artificial Sequence: Synthetic peptide"
QQYNQWPLT

SEQ ID NO: 169 - DNA, 33 bp, Artificial Sequence
  source: /note="Description of Artificial Sequence: Synthetic oligonucleotide"
agggccagtcagagtgttcatcatcacttagcc

SEQ ID NO: 170 - DNA, 21 bp, Artificial Sequence
  source: /note="Description of Artificial Sequence: Synthetic oligonucleotide"
gaagcagccaccagggccact

SEQ ID NO: 171 - DNA, 27 bp, Artificial Sequence
  source: /note="Description of Artificial Sequence: Synthetic oligonucleotide"
cagcagtataaccagtggcctctcact

SEQ ID NO: 172 - protein, 11 aa, Artificial Sequence
  source: /note="Description of Artificial Sequence: Synthetic peptide"
RASQSVHHHLA

SEQ ID NO: 173 - protein, 7 aa, Artificial Sequence
  source: /note="Description of Artificial Sequence: Synthetic peptide"
EAATRAT

SEQ ID NO: 174 - protein, 9 aa, Artificial Sequence
  source: /note="Description of Artificial Sequence: Synthetic peptide"
QQYNQWPLT

SEQ ID NO: 175 - DNA, 33 bp, Artificial Sequence; identical to SEQ ID NO: 163
  source: /note="Description of Artificial Sequence: Synthetic oligonucleotide"

SEQ ID NO: 176 - DNA, 21 bp, Artificial Sequence
  source: /note="Description of Artificial Sequence: Synthetic oligonucleotide"
gaagcagccaccagggccact

SEQ ID NO: 177 - DNA, 27 bp, Artificial Sequence
  source: /note="Description of Artificial Sequence: Synthetic oligonucleotide"
cagcagtataacaactggcctctcact

SEQ ID NO: 178 - protein, 11 aa, Artificial Sequence
  source: /note="Description of Artificial Sequence: Synthetic peptide"
RASQSVHSHLA

SEQ ID NO: 179 - protein, 7 aa, Artificial Sequence
  source: /note="Description of Artificial Sequence: Synthetic peptide"
EAATRAT

SEQ ID NO: 180 - protein, 9 aa, Artificial Sequence
  source: /note="Description of Artificial Sequence: Synthetic peptide"
QQYNNWPLT

SEQ ID NO: 181 - DNA, 33 bp, Artificial Sequence
  source: /note="Description of Artificial Sequence: Synthetic oligonucleotide"
agggccagtcagagtgttgatgtcaacttagcc

SEQ ID NO: 182 - DNA, 21 bp, Artificial Sequence
  source: /note="Description of Artificial Sequence: Synthetic oligonucleotide"
gaagcagccaccagggccact

SEQ ID NO: 183 - DNA, 27 bp, Artificial Sequence
  source: /note="Description of Artificial Sequence: Synthetic oligonucleotide"
cagcagtataaccagtggcctctcact

SEQ ID NO: 184 - protein, 11 aa, Artificial Sequence
  source: /note="Description of Artificial Sequence: Synthetic peptide"
RASQSVDVNLA

SEQ ID NO: 185 - protein, 7 aa, Artificial Sequence
  source: /note="Description of Artificial Sequence: Synthetic peptide"
EAATRAT

SEQ ID NO: 186 - protein, 9 aa, Artificial Sequence
  source: /note="Description of Artificial Sequence: Synthetic peptide"
QQYNQWPLT

SEQ ID NO: 187 - DNA, 33 bp, Artificial Sequence
  source: /note="Description of Artificial Sequence: Synthetic oligonucleotide"
agggccagtcagagtgttgatgtccacttagcc

SEQ ID NO: 188 - DNA, 21 bp, Artificial Sequence
  source: /note="Description of Artificial Sequence: Synthetic oligonucleotide"
gaagcagccaccagggccact

SEQ ID NO: 189 - DNA, 27 bp, Artificial Sequence
  source: /note="Description of Artificial Sequence: Synthetic oligonucleotide"
cagcagtataaccagtggcctctcact

SEQ ID NO: 190 - protein, 11 aa, Artificial Sequence
  source: /note="Description of Artificial Sequence: Synthetic peptide"
RASQSVDVHLA

SEQ ID NO: 191 - protein, 7 aa, Artificial Sequence
  source: /note="Description of Artificial Sequence: Synthetic peptide"
EAATRAT

SEQ ID NO: 192 - protein, 9 aa, Artificial Sequence
  source: /note="Description of Artificial Sequence: Synthetic peptide"
QQYNQWPLT

SEQ ID NO: 193 - DNA, 33 bp, Artificial Sequence; identical to SEQ ID NO: 151
  source: /note="Description of Artificial Sequence: Synthetic oligonucleotide"

SEQ ID NO: 194 - DNA, 21 bp, Artificial Sequence
  source: /note="Description of Artificial Sequence: Synthetic oligonucleotide"
gaagcagccaccagggccact

SEQ ID NO: 195 - DNA, 27 bp, Artificial Sequence
  source: /note="Description of Artificial Sequence: Synthetic oligonucleotide"
cagcagtataacaactggcctctcact

SEQ ID NO: 196 - protein, 11 aa, Artificial Sequence
  source: /note="Description of Artificial Sequence: Synthetic peptide"
RASQSVFEHLA

SEQ ID NO: 197 - protein, 7 aa, Artificial Sequence
  source: /note="Description of Artificial Sequence: Synthetic peptide"
EAATRAT

SEQ ID NO: 198 - protein, 9 aa, Artificial Sequence
  source: /note="Description of Artificial Sequence: Synthetic peptide"
QQYNNWPLT

SEQ ID NO: 199 - DNA, 33 bp, Artificial Sequence; identical to SEQ ID NO: 151
  source: /note="Description of Artificial Sequence: Synthetic oligonucleotide"

SEQ ID NO: 200 - DNA, 21 bp, Artificial Sequence
  source: /note="Description of Artificial Sequence: Synthetic oligonucleotide"
gaagcagccaccagggccact

SEQ ID NO: 201 - DNA, 27 bp, Artificial Sequence
  source: /note="Description of Artificial Sequence: Synthetic oligonucleotide"
cagcagtataacaactggcctctcact

SEQ ID NO: 202 - protein, 11 aa, Artificial Sequence
  source: /note="Description of Artificial Sequence: Synthetic peptide"
RASQSVFEHLA

SEQ ID NO: 203 - protein, 7 aa, Artificial Sequence
  source: /note="Description of Artificial Sequence: Synthetic peptide"
EAATRAT

SEQ ID NO: 204 - protein, 9 aa, Artificial Sequence
  source: /note="Description of Artificial Sequence: Synthetic peptide"
QQYNNWPLT

SEQ ID NO: 205 - DNA, 33 bp, Artificial Sequence
  source: /note="Description of Artificial Sequence: Synthetic oligonucleotide"
agggccagtcagagtgttttcgaacacttagcc

SEQ ID NO: 206 - DNA, 21 bp, Artificial Sequence
  source: /note="Description of Artificial Sequence: Synthetic oligonucleotide"
gaagcagccaccagggccact

SEQ ID NO: 207 - DNA, 27 bp, Artificial Sequence
  source: /note="Description of Artificial Sequence: Synthetic oligonucleotide"
cagcagtataaccagtggcctctcact

SEQ ID NO: 208 - protein, 11 aa, Artificial Sequence
  source: /note="Description of Artificial Sequence: Synthetic peptide"
RASQSVFEHLA

SEQ ID NO: 209 - protein, 7 aa, Artificial Sequence
  source: /note="Description of Artificial Sequence: Synthetic peptide"
EAATRAT

SEQ ID NO: 210 - protein, 9 aa, Artificial Sequence
  source: /note="Description of Artificial Sequence: Synthetic peptide"
QQYNQWPLT

SEQ ID NO: 211 - DNA, 33 bp, Artificial Sequence
  source: /note="Description of Artificial Sequence: Synthetic oligonucleotide"
agggccagtcagagtgttctggaacacttagcc

SEQ ID NO: 212 - DNA, 21 bp, Artificial Sequence
  source: /note="Description of Artificial Sequence: Synthetic oligonucleotide"
gaagcagccaccagggccact

SEQ ID NO: 213 - DNA, 27 bp, Artificial Sequence
  source: /note="Description of Artificial Sequence: Synthetic oligonucleotide"
cagcagtataacaactggcctctcact

SEQ ID NO: 214 - protein, 11 aa, Artificial Sequence
  source: /note="Description of Artificial Sequence: Synthetic peptide"
RASQSVLEHLA

SEQ ID NO: 215 - protein, 7 aa, Artificial Sequence
  source: /note="Description of Artificial Sequence: Synthetic peptide"
EAATRAT

SEQ ID NO: 216 - protein, 9 aa, Artificial Sequence
  source: /note="Description of Artificial Sequence: Synthetic peptide"
QQYNNWPLT

SEQ ID NO: 217 - DNA, 33 bp, Artificial Sequence; identical to SEQ ID NO: 1
  source: /note="Description of Artificial Sequence: Synthetic oligonucleotide"

SEQ ID NO: 218 - DNA, 21 bp, Artificial Sequence
  source: /note="Description of Artificial Sequence: Synthetic oligonucleotide"
gaagcagccaccagggccact

SEQ ID NO: 219 - DNA, 27 bp, Artificial Sequence
  source: /note="Description of Artificial Sequence: Synthetic oligonucleotide"
cagcagtataaccagtggcctctcact

SEQ ID NO: 220 - protein, 11 aa, Artificial Sequence
  source: /note="Description of Artificial Sequence: Synthetic peptide"
RASQSVDRHLA

SEQ ID NO: 221 - protein, 7 aa, Artificial Sequence
  source: /note="Description of Artificial Sequence: Synthetic peptide"
EAATRAT

SEQ ID NO: 222 - protein, 9 aa, Artificial Sequence
  source: /note="Description of Artificial Sequence: Synthetic peptide"
QQYNQWPLT

SEQ ID NO: 223 - DNA, 33 bp, Artificial Sequence
  source: /note="Description of Artificial Sequence: Synthetic oligonucleotide"
agggccagtcagagtgttaaccggcacttagcc

SEQ ID NO: 224 - DNA, 21 bp, Artificial Sequence
  source: /note="Description of Artificial Sequence: Synthetic oligonucleotide"
gaagcagccaccagggccact

SEQ ID NO: 225 - DNA, 27 bp, Artificial Sequence
  source: /note="Description of Artificial Sequence: Synthetic oligonucleotide"
cagcagtatcagcagtggcctctcact

SEQ ID NO: 226 - protein, 11 aa, Artificial Sequence
  source: /note="Description of Artificial Sequence: Synthetic peptide"
RASQSVNRHLA

SEQ ID NO: 227 - protein, 7 aa, Artificial Sequence
  source: /note="Description of Artificial Sequence: Synthetic peptide"
EAATRAT

SEQ ID NO: 228 - protein, 9 aa, Artificial Sequence
  source: /note="Description of Artificial Sequence: Synthetic peptide"
QQYQQWPLT

SEQ ID NO: 229 - DNA, 33 bp, Artificial Sequence
  source: /note="Description of Artificial Sequence: Synthetic oligonucleotide"
agggccagtcagagtgttaacgtacacttagcc

SEQ ID NO: 230 - DNA, 21 bp, Artificial Sequence
  source: /note="Description of Artificial Sequence: Synthetic oligonucleotide"
caggcagccaccagggccact

SEQ ID NO: 231 - DNA, 27 bp, Artificial Sequence
  source: /note="Description of Artificial Sequence: Synthetic oligonucleotide"
cagcagtataaccagtggcctctcact

SEQ ID NO: 232 - protein, 11 aa, Artificial Sequence
  source: /note="Description of Artificial Sequence: Synthetic peptide"
RASQSVNVHLA

SEQ ID NO: 233 - protein, 7 aa, Artificial Sequence
  source: /note="Description of Artificial Sequence: Synthetic peptide"
QAATRAT

SEQ ID NO: 234 - protein, 9 aa, Artificial Sequence
  source: /note="Description of Artificial Sequence: Synthetic peptide"
QQYNQWPLT

SEQ ID NO: 235 - DNA, 33 bp, Artificial Sequence; identical to SEQ ID NO: 67
  source: /note="Description of Artificial Sequence: Synthetic oligonucleotide"

SEQ ID NO: 236 - DNA, 21 bp, Artificial Sequence
  source: /note="Description of Artificial Sequence: Synthetic oligonucleotide"
gaagcagccaccagggccact

SEQ ID NO: 237 - DNA, 27 bp, Artificial Sequence
  source: /note="Description of Artificial Sequence: Synthetic oligonucleotide"
cagcagtatcagaactggcctctcact

SEQ ID NO: 238 - protein, 11 aa, Artificial Sequence
  source: /note="Description of Artificial Sequence: Synthetic peptide"
RASQSVLTHLA

SEQ ID NO: 239 - protein, 7 aa, Artificial Sequence
  source: /note="Description of Artificial Sequence: Synthetic peptide"
EAATRAT

SEQ ID NO: 240 - protein, 9 aa, Artificial Sequence
  source: /note="Description of Artificial Sequence: Synthetic peptide"
QQYQNWPLT

SEQ ID NO: 241 - DNA, 33 bp, Artificial Sequence; identical to SEQ ID NO: 67
  source: /note="Description of Artificial Sequence: Synthetic oligonucleotide"

SEQ ID NO: 242 - DNA, 21 bp, Artificial Sequence
  source: /note="Description of Artificial Sequence: Synthetic oligonucleotide"
gaagcagccaccagggccact

SEQ ID NO: 243 - DNA, 27 bp, Artificial Sequence
  source: /note="Description of Artificial Sequence: Synthetic oligonucleotide"
cagcagtatcagaactggcctctcact

SEQ ID NO: 244 - protein, 11 aa, Artificial Sequence
  source: /note="Description of Artificial Sequence: Synthetic peptide"
RASQSVLTHLA

SEQ ID NO: 245 - protein, 7 aa, Artificial Sequence
  source: /note="Description of Artificial Sequence: Synthetic peptide"
EAATRAT

SEQ ID NO: 246 - protein, 9 aa, Artificial Sequence
  source: /note="Description of Artificial Sequence: Synthetic peptide"
QQYQNWPLT

SEQ ID NO: 247 - DNA, 33 bp, Artificial Sequence
  source: /note="Description of Artificial Sequence: Synthetic oligonucleotide"
agggccagtcagagtgttagcagcaacttagcc

SEQ ID NO: 248 - DNA, 21 bp, Artificial Sequence
  source: /note="Description of Artificial Sequence: Synthetic oligonucleotide"
ggtgcagccaccagggccact

SEQ ID NO: 249 - DNA, 27 bp, Artificial Sequence
  source: /note="Description of Artificial Sequence: Synthetic oligonucleotide"
cagcagtataataactggcctctcact

SEQ ID NO: 250 - protein, 11 aa, Artificial Sequence
  source: /note="Description of Artificial Sequence: Synthetic peptide"
RASQSVSSNLA

SEQ ID NO: 251 - protein, 7 aa, Artificial Sequence
  source: /note="Description of Artificial Sequence: Synthetic peptide"
GAATRAT

SEQ ID NO: 252 - protein, 9 aa, Artificial Sequence
  source: /note="Description of Artificial Sequence: Synthetic peptide"
QQYNNWPLT

SEQ ID NO: 253 - DNA, 33 bp, Artificial Sequence; identical to SEQ ID NO: 247
  source: /note="Description of Artificial Sequence: Synthetic oligonucleotide"

SEQ ID NO: 254 - DNA, 21 bp, Artificial Sequence
  source: /note="Description of Artificial Sequence: Synthetic oligonucleotide"
ggtgcagccaccagggccact

SEQ ID NO: 255 - DNA, 27 bp, Artificial Sequence
  source: /note="Description of Artificial Sequence: Synthetic oligonucleotide"
cagcagtataataactggcctctcact

SEQ ID NO: 256 - protein, 11 aa, Artificial Sequence
  source: /note="Description of Artificial Sequence: Synthetic peptide"
RASQSVSSNLA

SEQ ID NO: 257 - protein, 7 aa, Artificial Sequence
  source: /note="Description of Artificial Sequence: Synthetic peptide"
GAATRAT

SEQ ID NO: 258 - protein, 9 aa, Artificial Sequence
  source: /note="Description of Artificial Sequence: Synthetic peptide"
QQYNNWPLT

SEQ ID NO: 259 - DNA, 33 bp, Artificial Sequence; identical to SEQ ID NO: 247
  source: /note="Description of Artificial Sequence: Synthetic oligonucleotide"

SEQ ID NO: 260 - DNA, 21 bp, Artificial Sequence
  source: /note="Description of Artificial Sequence: Synthetic oligonucleotide"
ggtgcagccaccagggccact

SEQ ID NO: 261 - DNA, 27 bp, Artificial Sequence
  source: /note="Description of Artificial Sequence: Synthetic oligonucleotide"
cagcagtataataactggcctctcact

SEQ ID NO: 262 - protein, 11 aa, Artificial Sequence
  source: /note="Description of Artificial Sequence: Synthetic peptide"
RASQSVSSNLA

SEQ ID NO: 263 - protein, 7 aa, Artificial Sequence
  source: /note="Description of Artificial Sequence: Synthetic peptide"
GAATRAT

SEQ ID NO: 264 - protein, 9 aa, Artificial Sequence
  source: /note="Description of Artificial Sequence: Synthetic peptide"
QQYNNWPLT

SEQ ID NO: 265 - DNA, 33 bp, Artificial Sequence; identical to SEQ ID NO: 247
  source: /note="Description of Artificial Sequence: Synthetic oligonucleotide"

SEQ ID NO: 266 - DNA, 21 bp, Artificial Sequence
  source: /note="Description of Artificial Sequence: Synthetic oligonucleotide"
ggtgcagccaccagggccact

SEQ ID NO: 267 - DNA, 27 bp, Artificial Sequence
  source: /note="Description of Artificial Sequence: Synthetic oligonucleotide"
cagcagtataataactggcctctcact

SEQ ID NO: 268 - protein, 11 aa, Artificial Sequence
  source: /note="Description of Artificial Sequence: Synthetic peptide"
RASQSVSSNLA

SEQ ID NO: 269 - protein, 7 aa, Artificial Sequence
  source: /note="Description of Artificial Sequence: Synthetic peptide"
GAATRAT

SEQ ID NO: 270 - protein, 9 aa, Artificial Sequence
  source: /note="Description of Artificial Sequence: Synthetic peptide"
QQYNNWPLT

SEQ ID NO: 271 - DNA, 33 bp, Artificial Sequence; identical to SEQ ID NO: 247
  source: /note="Description of Artificial Sequence: Synthetic oligonucleotide"

SEQ ID NO: 272 - DNA, 21 bp, Artificial Sequence
  source: /note="Description of Artificial Sequence: Synthetic oligonucleotide"
gaagcagccaccagggccact

SEQ ID NO: 273 - DNA, 27 bp, Artificial Sequence
  source: /note="Description of Artificial Sequence: Synthetic oligonucleotide"
cagcagtataataactggcctctcact

SEQ ID NO: 274 - protein, 11 aa, Artificial Sequence
  source: /note="Description of Artificial Sequence: Synthetic peptide"
RASQSVSSNLA

SEQ ID NO: 275 - protein, 7 aa, Artificial Sequence
  source: /note="Description of Artificial Sequence: Synthetic peptide"
EAATRAT

SEQ ID NO: 276 - protein, 9 aa, Artificial Sequence
  source: /note="Description of Artificial Sequence: Synthetic peptide"
QQYNNWPLT

SEQ ID NO: 277 - DNA, 33 bp, Artificial Sequence
  source: /note="Description of Artificial Sequence: Synthetic oligonucleotide"
agggccagtcagagtgttgatgttaacttagcc

SEQ ID NO: 278 - DNA, 21 bp, Artificial Sequence
  source: /note="Description of Artificial Sequence: Synthetic oligonucleotide"
aacgcagccaccagggccact

SEQ ID NO: 279 - DNA, 27 bp, Artificial Sequence
  source: /note="Description of Artificial Sequence: Synthetic oligonucleotide"
cagcagtatcagaactggcctctcact

SEQ ID NO: 280 - protein, 11 aa, Artificial Sequence
  source: /note="Description of Artificial Sequence: Synthetic peptide"
RASQSVDVNLA

SEQ ID NO: 281 - protein, 7 aa, Artificial Sequence
  source: /note="Description of Artificial Sequence: Synthetic peptide"
NAATRAT

SEQ ID NO: 282 - protein, 9 aa, Artificial Sequence
  source: /note="Description of Artificial Sequence: Synthetic peptide"
QQYQNWPLT

SEQ ID NO: 283 - DNA, 33 bp, Artificial Sequence; identical to SEQ ID NO: 277
  source: /note="Description of Artificial Sequence: Synthetic oligonucleotide"

SEQ ID NO: 284 - DNA, 21 bp, Artificial Sequence
  source: /note="Description of Artificial Sequence: Synthetic oligonucleotide"
aacgcagccaccagggccact

SEQ ID NO: 285 - DNA, 27 bp, Artificial Sequence
  source: /note="Description of Artificial Sequence: Synthetic oligonucleotide"
cagcagtatcagaactggcctctcact

SEQ ID NO: 286 - protein, 11 aa, Artificial Sequence
  source: /note="Description of Artificial Sequence: Synthetic peptide"
RASQSVDVNLA

SEQ ID NO: 287 - protein, 7 aa, Artificial Sequence
  source: /note="Description of Artificial Sequence: Synthetic peptide"
NAATRAT

SEQ ID NO: 288 - protein, 9 aa, Artificial Sequence
  source: /note="Description of Artificial Sequence: Synthetic peptide"
QQYQNWPLT

SEQ ID NO: 289 - DNA, 33 bp, Artificial Sequence
  source: /note="Description of Artificial Sequence: Synthetic oligonucleotide"
agggccagtcagagtgttcatacgaacttagcc

SEQ ID NO: 290 - DNA, 21 bp, Artificial Sequence
  source: /note="Description of Artificial Sequence: Synthetic oligonucleotide"
aacgcagccaccagggccact

SEQ ID NO: 291 - DNA, 27 bp, Artificial Sequence
  source: /note="Description of Artificial Sequence: Synthetic oligonucleotide"
cagcagtatcagaactggcctctcact

SEQ ID NO: 292 - protein, 11 aa, Artificial Sequence
  source: /note="Description of Artificial Sequence: Synthetic peptide"
RASQSVHTNLA

SEQ ID NO: 293 - protein, 7 aa, Artificial Sequence
  source: /note="Description of Artificial Sequence: Synthetic peptide"
NAATRAT

SEQ ID NO: 294 - protein, 9 aa, Artificial Sequence
  source: /note="Description of Artificial Sequence: Synthetic peptide"
QQYQNWPLT

SEQ ID NO: 295 - DNA, 33 bp, Artificial Sequence
  source: /note="Description of Artificial Sequence: Synthetic oligonucleotide"
agggccagtcagagtgttaacctgaacttagcc

SEQ ID NO: 296 - DNA, 21 bp, Artificial Sequence
  source: /note="Description of Artificial Sequence: Synthetic oligonucleotide"
caggcagccaccagggccact

SEQ ID NO: 297 - DNA, 27 bp, Artificial Sequence
  source: /note="Description of Artificial Sequence: Synthetic oligonucleotide"
cagcagtataaccagtggcctctcact

SEQ ID NO: 298 - protein, 11 aa, Artificial Sequence
  source: /note="Description of Artificial Sequence: Synthetic peptide"
RASQSVNLNLA

SEQ ID NO: 299 - protein, 7 aa, Artificial Sequence
  source: /note="Description of Artificial Sequence: Synthetic peptide"
QAATRAT

SEQ ID NO: 300 - protein, 9 aa, Artificial Sequence
  source: /note="Description of Artificial Sequence: Synthetic peptide"
QQYNQWPLT

SEQ ID NO: 301 - DNA, 33 bp, Artificial Sequence
  source: /note="Description of Artificial Sequence: Synthetic oligonucleotide"
agggccagtcagagtgttttccagaacttagcc

SEQ ID NO: 302 - DNA, 21 bp, Artificial Sequence
  source: /note="Description of Artificial Sequence: Synthetic oligonucleotide"
caggcagccaccagggccact

SEQ ID NO: 303 - DNA, 27 bp, Artificial Sequence
  source: /note="Description of Artificial Sequence: Synthetic oligonucleotide"
cagcagtataaccagtggcctctcact

SEQ ID NO: 304 - protein, 11 aa, Artificial Sequence
  source: /note="Description of Artificial Sequence: Synthetic peptide"
RASQSVFQNLA

SEQ ID NO: 305 - protein, 7 aa, Artificial Sequence
  source: /note="Description of Artificial Sequence: Synthetic peptide"
QAATRAT

SEQ ID NO: 306 - protein, 9 aa, Artificial Sequence
  source: /note="Description of Artificial Sequence: Synthetic peptide"
QQYNQWPLT

SEQ ID NO: 307 - DNA, 33 bp, Artificial Sequence; identical to SEQ ID NO: 1
  source: /note="Description of Artificial Sequence: Synthetic oligonucleotide"

SEQ ID NO: 308 - DNA, 21 bp, Artificial Sequence
  source: /note="Description of Artificial Sequence: Synthetic oligonucleotide"
gaagcagccaccagggccact

SEQ ID NO: 309 - DNA, 27 bp, Artificial Sequence
  source: /note="Description of Artificial Sequence: Synthetic oligonucleotide"
cagcagtataaccagtggcctctcact

SEQ ID NO: 310 - protein, 11 aa, Artificial Sequence
  source: /note="Description of Artificial Sequence: Synthetic peptide"
RASQSVDRHLA

SEQ ID NO: 311 - protein, 7 aa, Artificial Sequence
  source: /note="Description of Artificial Sequence: Synthetic peptide"
EAATRAT

SEQ ID NO: 312 - protein, 9 aa, Artificial Sequence
  source: /note="Description of Artificial Sequence: Synthetic peptide"
QQYNQWPLT

SEQ ID NO: 313 - DNA, 33 bp, Artificial Sequence; identical to SEQ ID NO: 1
  source: /note="Description of Artificial Sequence: Synthetic oligonucleotide"

SEQ ID NO: 314 - DNA, 21 bp, Artificial Sequence
  source: /note="Description of Artificial Sequence: Synthetic oligonucleotide"
gaagcagccaccagggccact

SEQ ID NO: 315 - DNA, 27 bp, Artificial Sequence
  source: /note="Description of Artificial Sequence: Synthetic oligonucleotide"
cagcagtataaccagtggcctctcact

SEQ ID NO: 316 - protein, 11 aa, Artificial Sequence
  source: /note="Description of Artificial Sequence: Synthetic peptide"
RASQSVDRHLA

SEQ ID NO: 317 - protein, 7 aa, Artificial Sequence
  source: /note="Description of Artificial Sequence: Synthetic peptide"
EAATRAT

SEQ ID NO: 318 - protein, 9 aa, Artificial Sequence
  source: /note="Description of Artificial Sequence: Synthetic peptide"
QQYNQWPLT

SEQ ID NO: 319 - DNA, 33 bp, Artificial Sequence; identical to SEQ ID NO: 223
  source: /note="Description of Artificial Sequence: Synthetic oligonucleotide"

SEQ ID NO: 320 - DNA, 21 bp, Artificial Sequence
  source: /note="Description of Artificial Sequence: Synthetic oligonucleotide"
gaagcagccaccagggccact

SEQ ID NO: 321 - DNA, 27 bp, Artificial Sequence
  source: /note="Description of Artificial Sequence: Synthetic oligonucleotide"
cagcagtataaccagtggcctctcact

SEQ ID NO: 322 - protein, 11 aa, Artificial Sequence
  source: /note="Description of Artificial Sequence: Synthetic peptide"
RASQSVNRHLA

SEQ ID NO: 323 - protein, 7 aa, Artificial Sequence
  source: /note="Description of Artificial Sequence: Synthetic peptide"
EAATRAT

SEQ ID NO: 324 - protein, 9 aa, Artificial Sequence
  source: /note="Description of Artificial Sequence: Synthetic peptide"
QQYNQWPLT

SEQ ID NO: 325 - DNA, 33 bp, Artificial Sequence; identical to SEQ ID NO: 19
  source: /note="Description of Artificial Sequence: Synthetic oligonucleotide"

SEQ ID NO: 326 - DNA, 21 bp, Artificial Sequence
  source: /note="Description of Artificial Sequence: Synthetic oligonucleotide"
gaagcagccaccagggccact

SEQ ID NO: 327 - DNA, 27 bp, Artificial Sequence
  source: /note="Description of Artificial Sequence: Synthetic oligonucleotide"
cagcagtatcagcagtggcctctcact

SEQ ID NO: 328 - protein, 11 aa, Artificial Sequence
  source: /note="Description of Artificial Sequence: Synthetic peptide"
RASQSVERHLA

SEQ ID NO: 329 - protein, 7 aa, Artificial Sequence
  source: /note="Description of Artificial Sequence: Synthetic peptide"
EAATRAT

SEQ ID NO: 330 - protein, 9 aa, Artificial Sequence
  source: /note="Description of Artificial Sequence: Synthetic peptide"
QQYQQWPLT

SEQ ID NO: 331 - DNA, 33 bp, Artificial Sequence; identical to SEQ ID NO: 25
  source: /note="Description of Artificial Sequence: Synthetic oligonucleotide"

SEQ ID NO: 332 - DNA, 21 bp, Artificial Sequence
  source: /note="Description of Artificial Sequence: Synthetic oligonucleotide"
gaagcagccaccagggccact

SEQ ID NO: 333 - DNA, 27 bp, Artificial Sequence
  source: /note="Description of Artificial Sequence: Synthetic oligonucleotide"
cagcagtatcagaactggcctctcact

SEQ ID NO: 334 - protein, 11 aa, Artificial Sequence
  source: /note="Description of Artificial Sequence: Synthetic peptide"
RASQSVFRHLA

SEQ ID NO: 335 - protein, 7 aa, Artificial Sequence
  source: /note="Description of Artificial Sequence: Synthetic peptide"
EAATRAT

SEQ ID NO: 336 - protein, 9 aa, Artificial Sequence
  source: /note="Description of Artificial Sequence: Synthetic peptide"
QQYQNWPLT

SEQ ID NO: 337 - DNA, 33 bp, Artificial Sequence; identical to SEQ ID NO: 49
  source: /note="Description of Artificial Sequence: Synthetic oligonucleotide"

SEQ ID NO: 338 - DNA, 21 bp, Artificial Sequence
  source: /note="Description of Artificial Sequence: Synthetic oligonucleotide"
gaagcagccaccagggccact

SEQ ID NO: 339 - DNA, 27 bp, Artificial Sequence
  source: /note="Description of Artificial Sequence: Synthetic oligonucleotide"
cagcagtataacaactggcctctcact

SEQ ID NO: 340 - protein, 11 aa, Artificial Sequence
  source: /note="Description of Artificial Sequence: Synthetic peptide"
RASQSVLSHLA

SEQ ID NO: 341 - protein, 7 aa, Artificial Sequence
  source: /note="Description of Artificial Sequence: Synthetic peptide"
EAATRAT

SEQ ID NO: 342 - protein, 9 aa, Artificial Sequence
  source: /note="Description of Artificial Sequence: Synthetic peptide"
QQYNNWPLT

SEQ ID NO: 343 - DNA, 33 bp, Artificial Sequence; identical to SEQ ID NO: 7
  source: /note="Description of Artificial Sequence: Synthetic oligonucleotide"

SEQ ID NO: 344 - DNA, 21 bp, Artificial Sequence
  source: /note="Description of Artificial Sequence: Synthetic oligonucleotide"
gaagcagccaccagggccact

SEQ ID NO: 345 - DNA, 27 bp, Artificial Sequence
  source: /note="Description of Artificial Sequence: Synthetic oligonucleotide"
cagcagtataacaactggcctctcact

SEQ ID NO: 346 - protein, 11 aa, Artificial Sequence
  source: /note="Description of Artificial Sequence: Synthetic peptide"
RASQSVNRHLA

SEQ ID NO: 347 - protein, 7 aa, Artificial Sequence
  source: /note="Description of Artificial Sequence: Synthetic peptide"
EAATRAT

SEQ ID NO: 348 - protein, 9 aa, Artificial Sequence
  source: /note="Description of Artificial Sequence: Synthetic peptide"
QQYNNWPLT

SEQ ID NO: 349 - DNA, 33 bp, Artificial Sequence
  source: /note="Description of Artificial Sequence: Synthetic oligonucleotide"
agggccagtcagagtgttaccagccacttagcc

SEQ ID NO: 350 - DNA, 21 bp, Artificial Sequence
  source: /note="Description of Artificial Sequence: Synthetic oligonucleotide"
gaagcagccaccagggccact

SEQ ID NO: 351 - DNA, 27 bp, Artificial Sequence
  source: /note="Description of Artificial Sequence: Synthetic oligonucleotide"
cagcagtataaccagtggcctctcact

SEQ ID NO: 352 - protein, 11 aa, Artificial Sequence
  source: /note="Description of Artificial Sequence: Synthetic peptide"
RASQSVTSHLA

SEQ ID NO: 353 - protein, 7 aa, Artificial Sequence
  source: /note="Description of Artificial Sequence: Synthetic peptide"
EAATRAT

SEQ ID NO: 354 - protein, 9 aa, Artificial Sequence
  source: /note="Description of Artificial Sequence: Synthetic peptide"
QQYNQWPLT

SEQ ID NO: 355 - DNA, 33 bp, Artificial Sequence
  source: /note="Description of Artificial Sequence: Synthetic oligonucleotide"
agggccagtcagagtgttgatcagcacttagcc

SEQ ID NO: 356 - DNA, 21 bp, Artificial Sequence
  source: /note="Description of Artificial Sequence: Synthetic oligonucleotide"
caggcagccaccagggccact

SEQ ID NO: 357 - DNA, 27 bp, Artificial Sequence
  source: /note="Description of Artificial Sequence: Synthetic oligonucleotide"
cagcagtatcagaactggcctctcact

SEQ ID NO: 358 - protein, 11 aa, Artificial Sequence
  source: /note="Description of Artificial Sequence: Synthetic peptide"
RASQSVDQHLA

SEQ ID NO: 359 - protein, 7 aa, Artificial Sequence
  source: /note="Description of Artificial Sequence: Synthetic peptide"
QAATRAT

SEQ ID NO: 360 - protein, 9 aa, Artificial Sequence
  source: /note="Description of Artificial Sequence: Synthetic peptide"
QQYQNWPLT

SEQ ID NO: 361 - DNA, 15 bp, Artificial Sequence
  source: /note="Description of Artificial Sequence: Synthetic oligonucleotide"
aactatggcatgcac

SEQ ID NO: 362 - DNA, 51 bp, Artificial Sequence
  source: /note="Description of Artificial Sequence: Synthetic oligonucleotide"
gctatatggtttgatgcaagtgataaatactatgcagacgccgtgaagggc

SEQ ID NO: 363 - DNA, 33 bp, Artificial Sequence
  source: /note="Description of Artificial Sequence: Synthetic oligonucleotide"
gatttggcgatttttggagtggtccccgactac

SEQ ID NO: 364 - protein, 5 aa, Artificial Sequence
  source: /note="Description of Artificial Sequence: Synthetic peptide"
NYGMH

SEQ ID NO: 365 - protein, 17 aa, Artificial Sequence
  source: /note="Description of Artificial Sequence: Synthetic peptide"
AIWFDASDKYYADAVKG

SEQ ID NO: 366 - protein, 11 aa, Artificial Sequence
  source: /note="Description of Artificial Sequence: Synthetic peptide"
DLAIFGVVPDY

SEQ ID NO: 367 - DNA, 15 bp, Artificial Sequence
  source: /note="Description of Artificial Sequence: Synthetic oligonucleotide"
aactatggcatgcac

SEQ ID NO: 368 - DNA, 51 bp, Artificial Sequence; identical to SEQ ID NO: 362
  source: /note="Description of Artificial Sequence: Synthetic oligonucleotide"

SEQ ID NO: 369 - DNA, 33 bp, Artificial Sequence; identical to SEQ ID NO: 363
  source: /note="Description of Artificial Sequence: Synthetic oligonucleotide"

SEQ ID NO: 370 - protein, 5 aa, Artificial Sequence
  source: /note="Description of Artificial Sequence: Synthetic peptide"
NYGMH

SEQ ID NO: 371 - protein, 17 aa, Artificial Sequence
  source: /note="Description of Artificial Sequence: Synthetic peptide"
AIWFDASDKYYADAVKG

SEQ ID NO: 372 - protein, 11 aa, Artificial Sequence
  source: /note="Description of Artificial Sequence: Synthetic peptide"
DLAIFGVVPDY

SEQ ID NO: 373 - DNA, 15 bp, Artificial Sequence
  source: /note="Description of Artificial Sequence: Synthetic oligonucleotide"
aactatggcatgcac

SEQ ID NO: 374 - DNA, 51 bp, Artificial Sequence; identical to SEQ ID NO: 362
  source: /note="Description of Artificial Sequence: Synthetic oligonucleotide"

SEQ ID NO: 375 - DNA, 33 bp, Artificial Sequence; identical to SEQ ID NO: 363
  source: /note="Description of Artificial Sequence: Synthetic oligonucleotide"

SEQ ID NO: 376 - protein, 5 aa, Artificial Sequence
  source: /note="Description of Artificial Sequence: Synthetic peptide"
NYGMH

SEQ ID NO: 377 - protein, 17 aa, Artificial Sequence
  source: /note="Description of Artificial Sequence: Synthetic peptide"
AIWFDASDKYYADAVKG

SEQ ID NO: 378 - protein, 11 aa, Artificial Sequence
  source: /note="Description of Artificial Sequence: Synthetic peptide"
DLAIFGVVPDY

SEQ ID NO: 379 - DNA, 15 bp, Artificial Sequence
  source: /note="Description of Artificial Sequence: Synthetic oligonucleotide"
aactatggcatgcac

SEQ ID NO: 380 - DNA, 51 bp, Artificial Sequence; identical to SEQ ID NO: 362
  source: /note="Description of Artificial Sequence: Synthetic oligonucleotide"

SEQ ID NO: 381 - DNA, 33 bp, Artificial Sequence; identical to SEQ ID NO: 363
  source: /note="Description of Artificial Sequence: Synthetic oligonucleotide"

SEQ ID NO: 382 - protein, 5 aa, Artificial Sequence
  source: /note="Description of Artificial Sequence: Synthetic peptide"
NYGMH

SEQ ID NO: 383 - protein, 17 aa, Artificial Sequence
  source: /note="Description of Artificial Sequence: Synthetic peptide"
AIWFDASDKYYADAVKG

SEQ ID NO: 384 - protein, 11 aa, Artificial Sequence
  source: /note="Description of Artificial Sequence: Synthetic peptide"
DLAIFGVVPDY

SEQ ID NO: 385 - DNA, 15 bp, Artificial Sequence
  source: /note="Description of Artificial Sequence: Synthetic oligonucleotide"
aactatggcatgcac

SEQ ID NO: 386 - DNA, 51 bp, Artificial Sequence; identical to SEQ ID NO: 362
  source: /note="Description of Artificial Sequence: Synthetic oligonucleotide"

SEQ ID NO: 387 - DNA, 33 bp, Artificial Sequence; identical to SEQ ID NO: 363
  source: /note="Description of Artificial Sequence: Synthetic oligonucleotide"

SEQ ID NO: 388 - protein, 5 aa, Artificial Sequence
  source: /note="Description of Artificial Sequence: Synthetic peptide"
NYGMH

SEQ ID NO: 389 - protein, 17 aa, Artificial Sequence
  source: /note="Description of Artificial Sequence: Synthetic peptide"
AIWFDASDKYYADAVKG

SEQ ID NO: 390 - protein, 11 aa, Artificial Sequence
  source: /note="Description of Artificial Sequence: Synthetic peptide"
DLAIFGVVPDY

SEQ ID NO: 391 - DNA, 15 bp, Artificial Sequence
  source: /note="Description of Artificial Sequence: Synthetic oligonucleotide"
aactatggcatgcac

SEQ ID NO: 392 - DNA, 51 bp, Artificial Sequence; identical to SEQ ID NO: 362
  source: /note="Description of Artificial Sequence: Synthetic oligonucleotide"

SEQ ID NO: 393 - DNA, 33 bp, Artificial Sequence; identical to SEQ ID NO: 363
  source: /note="Description of Artificial Sequence: Synthetic oligonucleotide"

SEQ ID NO: 394 - protein, 5 aa, Artificial Sequence
  source: /note="Description of Artificial Sequence: Synthetic peptide"
NYGMH

SEQ ID NO: 395 - protein, 17 aa, Artificial Sequence
  source: /note="Description of Artificial Sequence: Synthetic peptide"
AIWFDASDKYYADAVKG

SEQ ID NO: 396 - protein, 11 aa, Artificial Sequence
  source: /note="Description of Artificial Sequence: Synthetic peptide"
DLAIFGVVPDY

SEQ ID NO: 397 - DNA, 15 bp, Artificial Sequence
  source: /note="Description of Artificial Sequence: Synthetic oligonucleotide"
aactatggcatgcac

SEQ ID NO: 398 - DNA, 51 bp, Artificial Sequence; identical to SEQ ID NO: 362
  source: /note="Description of Artificial Sequence: Synthetic oligonucleotide"

SEQ ID NO: 399 - DNA, 33 bp, Artificial Sequence; identical to SEQ ID NO: 363
  source: /note="Description of Artificial Sequence: Synthetic oligonucleotide"

SEQ ID NO: 400 - protein, 5 aa, Artificial Sequence
  source: /note="Description of Artificial Sequence: Synthetic peptide"
NYGMH

SEQ ID NO: 401 - protein, 17 aa, Artificial Sequence
  source: /note="Description of Artificial Sequence: Synthetic peptide"
AIWFDASDKYYADAVKG

SEQ ID NO: 402 - protein, 11 aa, Artificial Sequence
  source: /note="Description of Artificial Sequence: Synthetic peptide"
DLAIFGVVPDY

SEQ ID NO: 403 - DNA, 15 bp, Artificial Sequence
  source: /note="Description of Artificial Sequence: Synthetic oligonucleotide"
aactatggcatgcac

SEQ ID NO: 404 - DNA, 51 bp, Artificial Sequence; identical to SEQ ID NO: 362
  source: /note="Description of Artificial Sequence: Synthetic oligonucleotide"

SEQ ID NO: 405 - DNA, 33 bp, Artificial Sequence; identical to SEQ ID NO: 363
  source: /note="Description of Artificial Sequence: Synthetic oligonucleotide"

SEQ ID NO: 406 - protein, 5 aa, Artificial Sequence
  source: /note="Description of Artificial Sequence: Synthetic peptide"
NYGMH

SEQ ID NO: 407 - protein, 17 aa, Artificial Sequence
  source: /note="Description of Artificial Sequence: Synthetic peptide"
AIWFDASDKYYADAVKG

SEQ ID NO: 408 - protein, 11 aa, Artificial Sequence
  source: /note="Description of Artificial Sequence: Synthetic peptide"
DLAIFGVVPDY

SEQ ID NO: 409 - DNA, 15 bp, Artificial Sequence
  source: /note="Description of Artificial Sequence: Synthetic oligonucleotide"
aactatggcatgcac

SEQ ID NO: 410 - DNA, 51 bp, Artificial Sequence; identical to SEQ ID NO: 362
  source: /note="Description of Artificial Sequence: Synthetic oligonucleotide"

SEQ ID NO: 411 - DNA, 33 bp, Artificial Sequence; identical to SEQ ID NO: 363
  source: /note="Description of Artificial Sequence: Synthetic oligonucleotide"

SEQ ID NO: 412 - protein, 5 aa, Artificial Sequence
  source: /note="Description of Artificial Sequence: Synthetic peptide"
NYGMH

SEQ ID NO: 413 - protein, 17 aa, Artificial Sequence
  source: /note="Description of Artificial Sequence: Synthetic peptide"
AIWFDASDKYYADAVKG

SEQ ID NO: 414 - protein, 11 aa, Artificial Sequence
  source: /note="Description of Artificial Sequence: Synthetic peptide"
DLAIFGVVPDY

SEQ ID NO: 415 - DNA, 15 bp, Artificial Sequence
  source: /note="Description of Artificial Sequence: Synthetic oligonucleotide"
aactatggcatgcac

SEQ ID NO: 416 - DNA, 51 bp, Artificial Sequence; identical to SEQ ID NO: 362
  source: /note="Description of Artificial Sequence: Synthetic oligonucleotide"

SEQ ID NO: 417 - DNA, 33 bp, Artificial Sequence; identical to SEQ ID NO: 363
  source: /note="Description of Artificial Sequence: Synthetic oligonucleotide"

SEQ ID NO: 418 - protein, 5 aa, Artificial Sequence
  source: /note="Description of Artificial Sequence: Synthetic peptide"
NYGMH

SEQ ID NO: 419 - protein, 17 aa, Artificial Sequence
  source: /note="Description of Artificial Sequence: Synthetic peptide"
AIWFDASDKYYADAVKG

SEQ ID NO: 420 - protein, 11 aa, Artificial Sequence
  source: /note="Description of Artificial Sequence: Synthetic peptide"
DLAIFGVVPDY

SEQ ID NO: 421 - DNA, 15 bp, Artificial Sequence
  source: /note="Description of Artificial Sequence: Synthetic oligonucleotide"
aactatggcatgcac

SEQ ID NO: 422 - DNA, 51 bp, Artificial Sequence; identical to SEQ ID NO: 362
  source: /note="Description of Artificial Sequence: Synthetic oligonucleotide"

SEQ ID NO: 423 - DNA, 33 bp, Artificial Sequence; identical to SEQ ID NO: 363
  source: /note="Description of Artificial Sequence: Synthetic oligonucleotide"

SEQ ID NO: 424 - protein, 5 aa, Artificial Sequence
  source: /note="Description of Artificial Sequence: Synthetic peptide"
NYGMH

SEQ ID NO: 425 - protein, 17 aa, Artificial Sequence
  source: /note="Description of Artificial Sequence: Synthetic peptide"
AIWFDASDKYYADAVKG

SEQ ID NO: 426 - protein, 11 aa, Artificial Sequence
  source: /note="Description of Artificial Sequence: Synthetic peptide"
DLAIFGVVPDY

SEQ ID NO: 427 - DNA, 15 bp, Artificial Sequence
  source: /note="Description of Artificial Sequence: Synthetic oligonucleotide"
aactatggcatgcac

SEQ ID NO: 428 - DNA, 51 bp, Artificial Sequence; identical to SEQ ID NO: 362
  source: /note="Description of Artificial Sequence: Synthetic oligonucleotide"

SEQ ID NO: 429 - DNA, 33 bp, Artificial Sequence; identical to SEQ ID NO: 363
  source: /note="Description of Artificial Sequence: Synthetic oligonucleotide"

SEQ ID NO: 430 - protein, 5 aa, Artificial Sequence
  source: /note="Description of Artificial Sequence: Synthetic peptide"
NYGMH

SEQ ID NO: 431 - protein, 17 aa, Artificial Sequence
  source: /note="Description of Artificial Sequence: Synthetic peptide"
AIWFDASDKYYADAVKG

SEQ ID NO: 432 - protein, 11 aa, Artificial Sequence
  source: /note="Description of Artificial Sequence: Synthetic peptide"
DLAIFGVVPDY

SEQ ID NO: 433 - DNA, 15 bp, Artificial Sequence
  source: /note="Description of Artificial Sequence: Synthetic oligonucleotide"
aactatggcatgcac

SEQ ID NO: 434 - DNA, 51 bp, Artificial Sequence; identical to SEQ ID NO: 362
  source: /note="Description of Artificial Sequence: Synthetic oligonucleotide"

SEQ ID NO: 435 - DNA, 33 bp, Artificial Sequence; identical to SEQ ID NO: 363
  source: /note="Description of Artificial Sequence: Synthetic oligonucleotide"

SEQ ID NO: 436 - protein, 5 aa, Artificial Sequence
  source: /note="Description of Artificial Sequence: Synthetic peptide"
NYGMH

SEQ ID NO: 437 - protein, 17 aa, Artificial Sequence
  source: /note="Description of Artificial Sequence: Synthetic peptide"
AIWFDASDKYYADAVKG

SEQ ID NO: 438 - protein, 11 aa, Artificial Sequence
  source: /note="Description of Artificial Sequence: Synthetic peptide"
DLAIFGVVPDY

SEQ ID NO: 439 - DNA, 15 bp, Artificial Sequence
  source: /note="Description of Artificial Sequence: Synthetic oligonucleotide"
aactatggcatgcac

SEQ ID NO: 440 - DNA, 51 bp, Artificial Sequence; identical to SEQ ID NO: 362
  source: /note="Description of Artificial Sequence: Synthetic oligonucleotide"

SEQ ID NO: 441 - DNA, 33 bp, Artificial Sequence
  source: /note="Description of Artificial Sequence: Synthetic oligonucleotide"
gatctggcgatttttggagtgattcccgactac

SEQ ID NO: 442 - protein, 5 aa, Artificial Sequence
  source: /note="Description of Artificial Sequence: Synthetic peptide"
NYGMH

SEQ ID NO: 443 - protein, 17 aa, Artificial Sequence
  source: /note="Description of Artificial Sequence: Synthetic peptide"
AIWFDASDKYYADAVKG

SEQ ID NO: 444 - protein, 11 aa, Artificial Sequence
  source: /note="Description of Artificial Sequence: Synthetic peptide"
DLAIFGVIPDY

SEQ ID NO: 445 - DNA, 15 bp, Artificial Sequence
  source: /note="Description of Artificial Sequence: Synthetic oligonucleotide"
aactatggcatgcac

SEQ ID NO: 446 - DNA, 51 bp, Artificial Sequence; identical to SEQ ID NO: 362
  source: /note="Description of Artificial Sequence: Synthetic oligonucleotide"

SEQ ID NO: 447 - DNA, 33 bp, Artificial Sequence; identical to SEQ ID NO: 363
  source: /note="Description of Artificial Sequence: Synthetic oligonucleotide"

SEQ ID NO: 448 - protein, 5 aa, Artificial Sequence
  source: /note="Description of Artificial Sequence: Synthetic peptide"
NYGMH

SEQ ID NO: 449 - protein, 17 aa, Artificial Sequence
  source: /note="Description of Artificial Sequence: Synthetic peptide"
AIWFDASDKYYADAVKG

SEQ ID NO: 450 - protein, 11 aa, Artificial Sequence
  source: /note="Description of Artificial Sequence: Synthetic peptide"
DLAIFGVVPDY

SEQ ID NO: 451 - DNA, 15 bp, Artificial Sequence
  source: /note="Description of Artificial Sequence: Synthetic oligonucleotide"
aactatggcatgcac

SEQ ID NO: 452 - DNA, 51 bp, Artificial Sequence; identical to SEQ ID NO: 362
  source: /note="Description of Artificial Sequence: Synthetic oligonucleotide"

SEQ ID NO: 453 - DNA, 33 bp, Artificial Sequence; identical to SEQ ID NO: 363
  source: /note="Description of Artificial Sequence: Synthetic oligonucleotide"

SEQ ID NO: 454 - protein, 5 aa, Artificial Sequence
  source: /note="Description of Artificial Sequence: Synthetic peptide"
NYGMH

SEQ ID NO: 455 - protein, 17 aa, Artificial Sequence
  source: /note="Description of Artificial Sequence: Synthetic peptide"
AIWFDASDKYYADAVKG

SEQ ID NO: 456 - protein, 11 aa, Artificial Sequence
  source: /note="Description of Artificial Sequence: Synthetic peptide"
DLAIFGVVPDY

SEQ ID NO: 457 - DNA, 15 bp, Artificial Sequence
  source: /note="Description of Artificial Sequence: Synthetic oligonucleotide"
aactatggcatgcac

SEQ ID NO: 458 - DNA, 51 bp, Artificial Sequence
  source: /note="Description of Artificial Sequence: Synthetic oligonucleotide"
gctatatggtttgatgcgtctgacaaatactatgcagacgccgtgaagggc

SEQ ID NO: 459 - DNA, 33 bp, Artificial Sequence
  source: /note="Description of Artificial Sequence: Synthetic oligonucleotide"
gatcttgcgatttttggagtggtccccgactac

SEQ ID NO: 460 - protein, 5 aa, Artificial Sequence
  source: /note="Description of Artificial Sequence: Synthetic peptide"
NYGMH

SEQ ID NO: 461 - protein, 17 aa, Artificial Sequence
  source: /note="Description of Artificial Sequence: Synthetic peptide"
AIWFDASDKYYADAVKG

SEQ ID NO: 462 - protein, 11 aa, Artificial Sequence
  source: /note="Description of Artificial Sequence: Synthetic peptide"
DLAIFGVVPDY

SEQ ID NO: 463 - DNA, 15 bp, Artificial Sequence
  source: /note="Description of Artificial Sequence: Synthetic oligonucleotide"
aactatggcatgcac

SEQ ID NO: 464 - DNA, 51 bp, Artificial Sequence; identical to SEQ ID NO: 458
  source: /note="Description of Artificial Sequence: Synthetic oligonucleotide"

SEQ ID NO: 465 - DNA, 33 bp, Artificial Sequence; identical to SEQ ID NO: 459
  source: /note="Description of Artificial Sequence: Synthetic oligonucleotide"

SEQ ID NO: 466 - protein, 5 aa, Artificial Sequence
  source: /note="Description of Artificial Sequence: Synthetic peptide"
NYGMH

SEQ ID NO: 467 - protein, 17 aa, Artificial Sequence
  source: /note="Description of Artificial Sequence: Synthetic peptide"
AIWFDASDKYYADAVKG

SEQ ID NO: 468 - protein, 11 aa, Artificial Sequence
  source: /note="Description of Artificial Sequence: Synthetic peptide"
DLAIFGVVPDY

SEQ ID NO: 469 - DNA, 15 bp, Artificial Sequence
  source: /note="Description of Artificial Sequence: Synthetic oligonucleotide"
aactatggcatgcac

SEQ ID NO: 470 - DNA, 51 bp, Artificial Sequence; identical to SEQ ID NO: 458
  source: /note="Description of Artificial Sequence: Synthetic oligonucleotide"

SEQ ID NO: 471 - DNA, 33 bp, Artificial Sequence; identical to SEQ ID NO: 459
  source: /note="Description of Artificial Sequence: Synthetic oligonucleotide"

SEQ ID NO: 472 - protein, 5 aa, Artificial Sequence
  source: /note="Description of Artificial Sequence: Synthetic peptide"
NYGMH

SEQ ID NO: 473 - protein, 17 aa, Artificial Sequence
  source: /note="Description of Artificial Sequence: Synthetic peptide"
AIWFDASDKYYADAVKG

SEQ ID NO: 474 - protein, 11 aa, Artificial Sequence
  source: /note="Description of Artificial Sequence: Synthetic peptide"
DLAIFGVVPDY

SEQ ID NO: 475 - DNA, 15 bp, Artificial Sequence
  source: /note="Description of Artificial Sequence: Synthetic oligonucleotide"
aactatggcatgcac

SEQ ID NO: 476 - DNA, 51 bp, Artificial Sequence; identical to SEQ ID NO: 362
  source: /note="Description of Artificial Sequence: Synthetic oligonucleotide"

SEQ ID NO: 477 - DNA, 33 bp, Artificial Sequence; identical to SEQ ID NO: 363
  source: /note="Description of Artificial Sequence: Synthetic oligonucleotide"

SEQ ID NO: 478 - protein, 5 aa, Artificial Sequence
  source: /note="Description of Artificial Sequence: Synthetic peptide"
NYGMH

SEQ ID NO: 479 - protein, 17 aa, Artificial Sequence
  source: /note="Description of Artificial Sequence: Synthetic peptide"
AIWFDASDKYYADAVKG

SEQ ID NO: 480 - protein, 11 aa, Artificial Sequence
  source: /note="Description of Artificial Sequence: Synthetic peptide"
DLAIFGVVPDY

SEQ ID NO: 481 - DNA, 15 bp, Artificial Sequence
  source: /note="Description of Artificial Sequence: Synthetic oligonucleotide"
aactatggcatgcac

SEQ ID NO: 482 - DNA, 51 bp, Artificial Sequence; identical to SEQ ID NO: 362
  source: /note="Description of Artificial Sequence: Synthetic oligonucleotide"

SEQ ID NO: 483 - DNA, 33 bp, Artificial Sequence; identical to SEQ ID NO: 363
  source: /note="Description of Artificial Sequence: Synthetic oligonucleotide"

SEQ ID NO: 484 - protein, 5 aa, Artificial Sequence
  source: /note="Description of Artificial Sequence: Synthetic peptide"
NYGMH

SEQ ID NO: 485 - protein, 17 aa, Artificial Sequence
  source: /note="Description of Artificial Sequence: Synthetic peptide"
AIWFDASDKYYADAVKG

SEQ ID NO: 486 - protein, 11 aa, Artificial Sequence
  source: /note="Description of Artificial Sequence: Synthetic peptide"
DLAIFGVVPDY

SEQ ID NO: 487 - DNA, 15 bp, Artificial Sequence
  source: /note="Description of Artificial Sequence: Synthetic oligonucleotide"
aactatggcatgcac

SEQ ID NO: 488 - DNA, 51 bp, Artificial Sequence; identical to SEQ ID NO: 362
  source: /note="Description of Artificial Sequence: Synthetic oligonucleotide"

SEQ ID NO: 489 - DNA, 33 bp, Artificial Sequence
  source: /note="Description of Artificial Sequence: Synthetic oligonucleotide"
gatattgcgatttttggagtggtccccgactac

SEQ ID NO: 490 - protein, 5 aa, Artificial Sequence
  source: /note="Description of Artificial Sequence: Synthetic peptide"
NYGMH

SEQ ID NO: 491 - protein, 17 aa, Artificial Sequence
  source: /note="Description of Artificial Sequence: Synthetic peptide"
AIWFDASDKYYADAVKG

SEQ ID NO: 492 - protein, 11 aa, Artificial Sequence
  source: /note="Description of Artificial Sequence: Synthetic peptide"
DIAIFGVVPDY

SEQ ID NO: 493 - DNA, 15 bp, Artificial Sequence
  source: /note="Description of Artificial Sequence: Synthetic oligonucleotide"
aactatggcatgcac

SEQ ID NO: 494 - DNA, 51 bp, Artificial Sequence; identical to SEQ ID NO: 362
  source: /note="Description of Artificial Sequence: Synthetic oligonucleotide"

SEQ ID NO: 495 - DNA, 33 bp, Artificial Sequence; identical to SEQ ID NO: 489
  source: /note="Description of Artificial Sequence: Synthetic oligonucleotide"

SEQ ID NO: 496 - protein, 5 aa, Artificial Sequence
  source: /note="Description of Artificial Sequence: Synthetic peptide"
NYGMH

SEQ ID NO: 497 - protein, 17 aa, Artificial Sequence
  source: /note="Description of Artificial Sequence: Synthetic peptide"
AIWFDASDKYYADAVKG

SEQ ID NO: 498 - protein, 11 aa, Artificial Sequence
  source: /note="Description of Artificial Sequence: Synthetic peptide"
DIAIFGVVPDY

SEQ ID NO: 499 - DNA, 15 bp, Artificial Sequence
  source: /note="Description of Artificial Sequence: Synthetic oligonucleotide"
aactatggcatgcac

SEQ ID NO: 500 - DNA, 51 bp, Artificial Sequence; identical to SEQ ID NO: 362
  source: /note="Description of Artificial Sequence: Synthetic oligonucleotide"

SEQ ID NO: 501 - DNA, 33 bp, Artificial Sequence; identical to SEQ ID NO: 363
  source: /note="Description of Artificial Sequence: Synthetic oligonucleotide"

SEQ ID NO: 502 - protein, 5 aa, Artificial Sequence
  source: /note="Description of Artificial Sequence: Synthetic peptide"
NYGMH

SEQ ID NO: 503 - protein, 17 aa, Artificial Sequence
  source: /note="Description of Artificial Sequence: Synthetic peptide"
AIWFDASDKYYADAVKG

SEQ ID NO: 504 - protein, 11 aa, Artificial Sequence
  source: /note="Description of Artificial Sequence: Synthetic peptide"
DLAIFGVVPDY

SEQ ID NO: 505 - DNA, 15 bp, Artificial Sequence
  source: /note="Description of Artificial Sequence: Synthetic oligonucleotide"
aactatggcatgcac

SEQ ID NO: 506 - DNA, 51 bp, Artificial Sequence; identical to SEQ ID NO: 362
  source: /note="Description of Artificial Sequence: Synthetic oligonucleotide"

SEQ ID NO: 507 - DNA, 33 bp, Artificial Sequence; identical to SEQ ID NO: 363
  source: /note="Description of Artificial Sequence: Synthetic oligonucleotide"

SEQ ID NO: 508 - protein, 5 aa, Artificial Sequence
  source: /note="Description of Artificial Sequence: Synthetic peptide"
NYGMH

SEQ ID NO: 509 - protein, 17 aa, Artificial Sequence
  source: /note="Description of Artificial Sequence: Synthetic peptide"
AIWFDASDKYYADAVKG

SEQ ID NO: 510 - protein, 11 aa, Artificial Sequence
  source: /note="Description of Artificial Sequence: Synthetic peptide"
DLAIFGVVPDY

SEQ ID NO: 511 - DNA, 15 bp, Artificial Sequence
  source: /note="Description of Artificial Sequence: Synthetic oligonucleotide"
aactatggcatgcac

SEQ ID NO: 512 - DNA, 51 bp, Artificial Sequence; identical to SEQ ID NO: 362
  source: /note="Description of Artificial Sequence: Synthetic oligonucleotide"

SEQ ID NO: 513 - DNA, 33 bp, Artificial Sequence; identical to SEQ ID NO: 363
  source: /note="Description of Artificial Sequence: Synthetic oligonucleotide"

SEQ ID NO: 514 - protein, 5 aa, Artificial Sequence
  source: /note="Description of Artificial Sequence: Synthetic peptide"
NYGMH

SEQ ID NO: 515 - protein, 17 aa, Artificial Sequence
  source: /note="Description of Artificial Sequence: Synthetic peptide"
AIWFDASDKYYADAVKG

SEQ ID NO: 516 - protein, 11 aa, Artificial Sequence
  source: /note="Description of Artificial Sequence: Synthetic peptide"
DLAIFGVVPDY

SEQ ID NO: 517 - DNA, 15 bp, Artificial Sequence
  source: /note="Description of Artificial Sequence: Synthetic oligonucleotide"
aactatggcatgcac

SEQ ID NO: 518 - DNA, 51 bp, Artificial Sequence; identical to SEQ ID NO: 362
  source: /note="Description of Artificial Sequence: Synthetic oligonucleotide"

SEQ ID NO: 519 - DNA, 33 bp, Artificial Sequence; identical to SEQ ID NO: 363
  source: /note="Description of Artificial Sequence: Synthetic oligonucleotide"

SEQ ID NO: 520 - protein, 5 aa, Artificial Sequence
  source: /note="Description of Artificial Sequence: Synthetic peptide"
NYGMH

SEQ ID NO: 521 - protein, 17 aa, Artificial Sequence
  source: /note="Description of Artificial Sequence: Synthetic peptide"
AIWFDASDKYYADAVKG

SEQ ID NO: 522 - protein, 11 aa, Artificial Sequence
  source: /note="Description of Artificial Sequence: Synthetic peptide"
DLAIFGVVPDY

SEQ ID NO: 523 - DNA, 15 bp, Artificial Sequence
  source: /note="Description of Artificial Sequence: Synthetic oligonucleotide"
aactatggcatgcac

SEQ ID NO: 524 - DNA, 51 bp, Artificial Sequence; identical to SEQ ID NO: 362
  source: /note="Description of Artificial Sequence: Synthetic oligonucleotide"

SEQ ID NO: 525 - DNA, 33 bp, Artificial Sequence; identical to SEQ ID NO: 363
  source: /note="Description of Artificial Sequence: Synthetic oligonucleotide"

SEQ ID NO: 526 - protein, 5 aa, Artificial Sequence
  source: /note="Description of Artificial Sequence: Synthetic peptide"
NYGMH

SEQ ID NO: 527 - protein, 17 aa, Artificial Sequence
  source: /note="Description of Artificial Sequence: Synthetic peptide"
AIWFDASDKYYADAVKG

SEQ ID NO: 528 - protein, 11 aa, Artificial Sequence
  source: /note="Description of Artificial Sequence: Synthetic peptide"
DLAIFGVVPDY

SEQ ID NO: 529 - DNA, 15 bp, Artificial Sequence
  source: /note="Description of Artificial Sequence: Synthetic oligonucleotide"
aactatggcatgcac

SEQ ID NO: 530 - DNA, 51 bp, Artificial Sequence; identical to SEQ ID NO: 362
  source: /note="Description of Artificial Sequence: Synthetic oligonucleotide"

SEQ ID NO: 531 - DNA, 33 bp, Artificial Sequence; identical to SEQ ID NO: 363
  source: /note="Description of Artificial Sequence: Synthetic oligonucleotide"

SEQ ID NO: 532 - protein, 5 aa, Artificial Sequence
  source: /note="Description of Artificial Sequence: Synthetic peptide"
NYGMH

SEQ ID NO: 533 - protein, 17 aa, Artificial Sequence
  source: /note="Description of Artificial Sequence: Synthetic peptide"
AIWFDASDKYYADAVKG

SEQ ID NO: 534 - protein, 11 aa, Artificial Sequence
  source: /note="Description of Artificial Sequence: Synthetic peptide"
DLAIFGVVPDY

SEQ ID NO: 535 - DNA, 15 bp, Artificial Sequence
  source: /note="Description of Artificial Sequence: Synthetic oligonucleotide"
aactatggcatgcac

SEQ ID NO: 536 - DNA, 51 bp, Artificial Sequence; identical to SEQ ID NO: 362
  source: /note="Description of Artificial Sequence: Synthetic oligonucleotide"

SEQ ID NO: 537 - DNA, 33 bp, Artificial Sequence; identical to SEQ ID NO: 363
  source: /note="Description of Artificial Sequence: Synthetic oligonucleotide"

SEQ ID NO: 538 - protein, 5 aa, Artificial Sequence
  source: /note="Description of Artificial Sequence: Synthetic peptide"
NYGMH

SEQ ID NO: 539 - protein, 17 aa, Artificial Sequence
  source: /note="Description of Artificial Sequence: Synthetic peptide"
AIWFDASDKYYADAVKG

SEQ ID NO: 540 - protein, 11 aa, Artificial Sequence
  source: /note="Description of Artificial Sequence: Synthetic peptide"
DLAIFGVVPDY

SEQ ID NO: 541 - DNA, 15 bp, Artificial Sequence
  source: /note="Description of Artificial Sequence: Synthetic oligonucleotide"
aactatggcatgcac

SEQ ID NO: 542 - DNA, 51 bp, Artificial Sequence; identical to SEQ ID NO: 362
  source: /note="Description of Artificial Sequence: Synthetic oligonucleotide"

SEQ ID NO: 543 - DNA, 33 bp, Artificial Sequence; identical to SEQ ID NO: 363
  source: /note="Description of Artificial Sequence: Synthetic oligonucleotide"

SEQ ID NO: 544 - protein, 5 aa, Artificial Sequence
  source: /note="Description of Artificial Sequence: Synthetic peptide"
NYGMH

SEQ ID NO: 545 - protein, 17 aa, Artificial Sequence
  source: /note="Description of Artificial Sequence: Synthetic peptide"
AIWFDASDKYYADAVKG

SEQ ID NO: 546 - protein, 11 aa, Artificial Sequence
  source: /note="Description of Artificial Sequence: Synthetic peptide"
DLAIFGVVPDY

SEQ ID NO: 547 - DNA, 15 bp, Artificial Sequence
  source: /note="Description of Artificial Sequence: Synthetic oligonucleotide"
aactatggcatgcac

SEQ ID NO: 548 - DNA, 51 bp, Artificial Sequence; identical to SEQ ID NO: 362
  source: /note="Description of Artificial Sequence: Synthetic oligonucleotide"

SEQ ID NO: 549 - DNA, 33 bp, Artificial Sequence; identical to SEQ ID NO: 363
  source: /note="Description of Artificial Sequence: Synthetic oligonucleotide"

SEQ ID NO: 550 - protein, 5 aa, Artificial Sequence
  source: /note="Description of Artificial Sequence: Synthetic peptide"
NYGMH

SEQ ID NO: 551 - protein, 17 aa, Artificial Sequence
  source: /note="Description of Artificial Sequence: Synthetic peptide"
AIWFDASDKYYADAVKG

SEQ ID NO: 552 - protein, 11 aa, Artificial Sequence
  source: /note="Description of Artificial Sequence: Synthetic peptide"
DLAIFGVVPDY

SEQ ID NO: 553 - DNA, 15 bp, Artificial Sequence
  source: /note="Description of Artificial Sequence: Synthetic oligonucleotide"
aactatggcatgcac

SEQ ID NO: 554 - DNA, 51 bp, Artificial Sequence; identical to SEQ ID NO: 362
  source: /note="Description of Artificial Sequence: Synthetic oligonucleotide"

SEQ ID NO: 555 - DNA, 33 bp, Artificial Sequence
  source: /note="Description of Artificial Sequence: Synthetic oligonucleotide"
gatattgcgatttttggagtgtttcccgactac

SEQ ID NO: 556 - protein, 5 aa, Artificial Sequence
  source: /note="Description of Artificial Sequence: Synthetic peptide"
NYGMH

SEQ ID NO: 557 - protein, 17 aa, Artificial Sequence
  source: /note="Description of Artificial Sequence: Synthetic peptide"
AIWFDASDKYYADAVKG

SEQ ID NO: 558 - protein, 11 aa, Artificial Sequence
  source: /note="Description of Artificial Sequence: Synthetic peptide"
DIAIFGVFPDY

SEQ ID NO: 559 - DNA, 15 bp, Artificial Sequence
  source: /note="Description of Artificial Sequence: Synthetic oligonucleotide"
aactatggcatgcac

SEQ ID NO: 560 - DNA, 51 bp, Artificial Sequence; identical to SEQ ID NO: 362
  source: /note="Description of Artificial Sequence: Synthetic oligonucleotide"

SEQ ID NO: 561 - DNA, 33 bp, Artificial Sequence; identical to SEQ ID NO: 555
  source: /note="Description of Artificial Sequence: Synthetic oligonucleotide"

SEQ ID NO: 562 - protein, 5 aa, Artificial Sequence
  source: /note="Description of Artificial Sequence: Synthetic peptide"
NYGMH

SEQ ID NO: 563 - protein, 17 aa, Artificial Sequence
  source: /note="Description of Artificial Sequence: Synthetic peptide"
AIWFDASDKYYADAVKG

SEQ ID NO: 564 - protein, 11 aa, Artificial Sequence
  source: /note="Description of Artificial Sequence: Synthetic peptide"
DIAIFGVFPDY

SEQ ID NO: 565 - DNA, 15 bp, Artificial Sequence
  source: /note="Description of Artificial Sequence: Synthetic oligonucleotide"
aactatggcatgcac

SEQ ID NO: 566 - DNA, 51 bp, Artificial Sequence; identical to SEQ ID NO: 362
  source: /note="Description of Artificial Sequence: Synthetic oligonucleotide"

SEQ ID NO: 567 - DNA, 33 bp, Artificial Sequence; identical to SEQ ID NO: 489
  source: /note="Description of Artificial Sequence: Synthetic oligonucleotide"

SEQ ID NO: 568 - protein, 5 aa, Artificial Sequence
  source: /note="Description of Artificial Sequence: Synthetic peptide"
NYGMH

SEQ ID NO: 569 - protein, 17 aa, Artificial Sequence
  source: /note="Description of Artificial Sequence: Synthetic peptide"
AIWFDASDKYYADAVKG

SEQ ID NO: 570 - protein, 11 aa, Artificial Sequence
  source: /note="Description of Artificial Sequence: Synthetic peptide"
DIAIFGVVPDY

SEQ ID NO: 571 - DNA, 15 bp, Artificial Sequence
  source: /note="Description of Artificial Sequence: Synthetic oligonucleotide"
aactatggcatgcac

SEQ ID NO: 572 - DNA, 51 bp, Artificial Sequence; identical to SEQ ID NO: 362
  source: /note="Description of Artificial Sequence: Synthetic oligonucleotide"

SEQ ID NO: 573 - DNA, 33 bp, Artificial Sequence; identical to SEQ ID NO: 489
  source: /note="Description of Artificial Sequence: Synthetic oligonucleotide"

SEQ ID NO: 574 - protein, 5 aa, Artificial Sequence
  source: /note="Description of Artificial Sequence: Synthetic peptide"
NYGMH

SEQ ID NO: 575 - protein, 17 aa, Artificial Sequence
  source: /note="Description of Artificial Sequence: Synthetic peptide"
AIWFDASDKYYADAVKG

SEQ ID NO: 576 - protein, 11 aa, Artificial Sequence
  source: /note="Description of Artificial Sequence: Synthetic peptide"
DIAIFGVVPDY

SEQ ID NO: 577 - DNA, 15 bp, Artificial Sequence
  source: /note="Description of Artificial Sequence: Synthetic oligonucleotide"
aactatggcatgcac

SEQ ID NO: 578 - DNA, 51 bp, Artificial Sequence; identical to SEQ ID NO: 362
  source: /note="Description of Artificial Sequence: Synthetic oligonucleotide"

SEQ ID NO: 579 - DNA, 33 bp, Artificial Sequence; identical to SEQ ID NO: 555
  source: /note="Description of Artificial Sequence: Synthetic oligonucleotide"

SEQ ID NO: 580 - protein, 5 aa, Artificial Sequence
  source: /note="Description of Artificial Sequence: Synthetic peptide"
NYGMH

SEQ ID NO: 581 - protein, 17 aa, Artificial Sequence
  source: /note="Description of Artificial Sequence: Synthetic peptide"
AIWFDASDKYYADAVKG

SEQ ID NO: 582 - protein, 11 aa, Artificial Sequence
  source: /note="Description of Artificial Sequence: Synthetic peptide"
DIAIFGVFPDY

SEQ ID NO: 583 - DNA, 15 bp, Artificial Sequence
  source: /note="Description of Artificial Sequence: Synthetic oligonucleotide"
aactatggcatgcac

SEQ ID NO: 584 - DNA, 51 bp, Artificial Sequence; identical to SEQ ID NO: 362
  source: /note="Description of Artificial Sequence: Synthetic oligonucleotide"

SEQ ID NO: 585 - DNA, 33 bp, Artificial Sequence; identical to SEQ ID NO: 555
  source: /note="Description of Artificial Sequence: Synthetic oligonucleotide"

SEQ ID NO: 586 - protein, 5 aa, Artificial Sequence
  source: /note="Description of Artificial Sequence: Synthetic peptide"
NYGMH

SEQ ID NO: 587 - protein, 17 aa, Artificial Sequence
  source: /note="Description of Artificial Sequence: Synthetic peptide"
AIWFDASDKYYADAVKG

SEQ ID NO: 588 - protein, 11 aa, Artificial Sequence
  source: /note="Description of Artificial Sequence: Synthetic peptide"
DIAIFGVFPDY

SEQ ID NO: 589 - DNA, 15 bp, Artificial Sequence
  source: /note="Description of Artificial Sequence: Synthetic oligonucleotide"
aactatggcatgcac

SEQ ID NO: 590 - DNA, 51 bp, Artificial Sequence; identical to SEQ ID NO: 362
  source: /note="Description of Artificial Sequence: Synthetic oligonucleotide"

SEQ ID NO: 591 - DNA, 33 bp, Artificial Sequence; identical to SEQ ID NO: 555
  source: /note="Description of Artificial Sequence: Synthetic oligonucleotide"

SEQ ID NO: 592 - protein, 5 aa, Artificial Sequence
  source: /note="Description of Artificial Sequence: Synthetic peptide"
NYGMH

SEQ ID NO: 593 - protein, 17 aa, Artificial Sequence
  source: /note="Description of Artificial Sequence: Synthetic peptide"
AIWFDASDKYYADAVKG

SEQ ID NO: 594 - protein, 11 aa, Artificial Sequence
  source: /note="Description of Artificial Sequence: Synthetic peptide"
DIAIFGVFPDY

SEQ ID NO: 595 - DNA, 15 bp, Artificial Sequence
  source: /note="Description of Artificial Sequence: Synthetic oligonucleotide"
aactatggcatgcac

SEQ ID NO: 596 - DNA, 51 bp, Artificial Sequence; identical to SEQ ID NO: 362
  source: /note="Description of Artificial Sequence: Synthetic oligonucleotide"

SEQ ID NO: 597 - DNA, 33 bp, Artificial Sequence
  source: /note="Description of Artificial Sequence: Synthetic oligonucleotide"
gatattgcgatttttggagtgatccccgactac

SEQ ID NO: 598 - protein, 5 aa, Artificial Sequence
  source: /note="Description of Artificial Sequence: Synthetic peptide"
NYGMH

SEQ ID NO: 599 - protein, 17 aa, Artificial Sequence
  source: /note="Description of Artificial Sequence: Synthetic peptide"
AIWFDASDKYYADAVKG

SEQ ID NO: 600 - protein, 11 aa, Artificial Sequence
  source: /note="Description of Artificial Sequence: Synthetic peptide"
DIAIFGVIPDY

SEQ ID NO: 601 - DNA, 15 bp, Artificial Sequence
  source: /note="Description of Artificial Sequence: Synthetic oligonucleotide"
aactatggcatgcac

SEQ ID NO: 602 - DNA, 51 bp, Artificial Sequence; identical to SEQ ID NO: 362
  source: /note="Description of Artificial Sequence: Synthetic oligonucleotide"

SEQ ID NO: 603 - DNA, 33 bp, Artificial Sequence; identical to SEQ ID NO: 597
  source: /note="Description of Artificial Sequence: Synthetic oligonucleotide"

SEQ ID NO: 604 - protein, 5 aa, Artificial Sequence
  source: /note="Description of Artificial Sequence: Synthetic peptide"
NYGMH

SEQ ID NO: 605 - protein, 17 aa, Artificial Sequence
  source: /note="Description of Artificial Sequence: Synthetic peptide"
AIWFDASDKYYADAVKG

SEQ ID NO: 606 - protein, 11 aa, Artificial Sequence
  source: /note="Description of Artificial Sequence: Synthetic peptide"
DIAIFGVIPDY

SEQ ID NO: 607 - DNA, 15 bp, Artificial Sequence
  source: /note="Description of Artificial Sequence: Synthetic oligonucleotide"
aactatggcatgcac

SEQ ID NO: 608 - DNA, 51 bp, Artificial Sequence; identical to SEQ ID NO: 362
  source: /note="Description of Artificial Sequence: Synthetic oligonucleotide"

SEQ ID NO: 609 - DNA, 33 bp, Artificial Sequence; identical to SEQ ID NO: 363
  source: /note="Description of Artificial Sequence: Synthetic oligonucleotide"

SEQ ID NO: 610 - protein, 5 aa, Artificial Sequence
  source: /note="Description of Artificial Sequence: Synthetic peptide"
NYGMH

SEQ ID NO: 611 - protein, 17 aa, Artificial Sequence
  source: /note="Description of Artificial Sequence: Synthetic peptide"
AIWFDASDKYYADAVKG

SEQ ID NO: 612 - protein, 11 aa, Artificial Sequence
  source: /note="Description of Artificial Sequence: Synthetic peptide"
DLAIFGVVPDY

SEQ ID NO: 613 - DNA, 15 bp, Artificial Sequence
  source: /note="Description of Artificial Sequence: Synthetic oligonucleotide"
aactatggcatgcac

SEQ ID NO: 614 - DNA, 51 bp, Artificial Sequence; identical to SEQ ID NO: 362
  source: /note="Description of Artificial Sequence: Synthetic oligonucleotide"

SEQ ID NO: 615 - DNA, 33 bp, Artificial Sequence
  source: /note="Description of Artificial Sequence: Synthetic oligonucleotide"
gatcaggcgatttttggagtggtccccgattac

SEQ ID NO: 616 - protein, 5 aa, Artificial Sequence
  source: /note="Description of Artificial Sequence: Synthetic peptide"
NYGMH

SEQ ID NO: 617 - protein, 17 aa, Artificial Sequence
  source: /note="Description of Artificial Sequence: Synthetic peptide"
AIWFDASDKYYADAVKG

SEQ ID NO: 618 - protein, 11 aa, Artificial Sequence
  source: /note="Description of Artificial Sequence: Synthetic peptide"
DQAIFGVVPDY

SEQ ID NO: 619 - DNA, 15 bp, Artificial Sequence
  source: /note="Description of Artificial Sequence: Synthetic oligonucleotide"
aactatggcatgcac

SEQ ID NO: 620 - DNA, 51 bp, Artificial Sequence; identical to SEQ ID NO: 362
  source: /note="Description of Artificial Sequence: Synthetic oligonucleotide"

SEQ ID NO: 621 - DNA, 33 bp, Artificial Sequence; identical to SEQ ID NO: 489
  source: /note="Description of Artificial Sequence: Synthetic oligonucleotide"

SEQ ID NO: 622 - protein, 5 aa, Artificial Sequence
  source: /note="Description of Artificial Sequence: Synthetic peptide"
NYGMH

SEQ ID NO: 623 - protein, 17 aa, Artificial Sequence
  source: /note="Description of Artificial Sequence: Synthetic peptide"
AIWFDASDKYYADAVKG

SEQ ID NO: 624 - protein, 11 aa, Artificial Sequence
  source: /note="Description of Artificial Sequence: Synthetic peptide"
DIAIFGVVPDY

SEQ ID NO: 625 - DNA, 15 bp, Artificial Sequence
  source: /note="Description of Artificial Sequence: Synthetic oligonucleotide"
aactatggcatgcac

SEQ ID NO: 626 - DNA, 51 bp, Artificial Sequence; identical to SEQ ID NO: 362
  source: /note="Description of Artificial Sequence: Synthetic oligonucleotide"

SEQ ID NO: 627 - DNA, 33 bp, Artificial Sequence; identical to SEQ ID NO: 363
  source: /note="Description of Artificial Sequence: Synthetic oligonucleotide"

SEQ ID NO: 628 - protein, 5 aa, Artificial Sequence
  source: /note="Description of Artificial Sequence: Synthetic peptide"
NYGMH

SEQ ID NO: 629 - protein, 17 aa, Artificial Sequence
  source: /note="Description of Artificial Sequence: Synthetic peptide"
AIWFDASDKYYADAVKG

SEQ ID NO: 630 - protein, 11 aa, Artificial Sequence
  source: /note="Description of Artificial Sequence: Synthetic peptide"
DLAIFGVVPDY

SEQ ID NO: 631 - DNA, 15 bp, Artificial Sequence
  source: /note="Description of Artificial Sequence: Synthetic oligonucleotide"
aactatggcatgcac

SEQ ID NO: 632 - DNA, 51 bp, Artificial Sequence; identical to SEQ ID NO: 362
  source: /note="Description of Artificial Sequence: Synthetic oligonucleotide"

SEQ ID NO: 633 - DNA, 33 bp, Artificial Sequence; identical to SEQ ID NO: 615
  source: /note="Description of Artificial Sequence: Synthetic oligonucleotide"

SEQ ID NO: 634 - protein, 5 aa, Artificial Sequence
  source: /note="Description of Artificial Sequence: Synthetic peptide"
NYGMH

SEQ ID NO: 635 - protein, 17 aa, Artificial Sequence
  source: /note="Description of Artificial Sequence: Synthetic peptide"
AIWFDASDKYYADAVKG

SEQ ID NO: 636 - protein, 11 aa, Artificial Sequence
  source: /note="Description of Artificial Sequence: Synthetic peptide"
DQAIFGVVPDY

SEQ ID NO: 637 - DNA, 15 bp, Artificial Sequence
  source: /note="Description of Artificial Sequence: Synthetic oligonucleotide"
aactatggcatgcac

SEQ ID NO: 638 - DNA, 51 bp, Artificial Sequence; identical to SEQ ID NO: 362
  source: /note="Description of Artificial Sequence: Synthetic oligonucleotide"

SEQ ID NO: 639 - DNA, 33 bp, Artificial Sequence; identical to SEQ ID NO: 363
  source: /note="Description of Artificial Sequence: Synthetic oligonucleotide"

SEQ ID NO: 640 - protein, 5 aa, Artificial Sequence
  source: /note="Description of Artificial Sequence: Synthetic peptide"
NYGMH

SEQ ID NO: 641 - protein, 17 aa, Artificial Sequence
  source: /note="Description of Artificial Sequence: Synthetic peptide"
AIWFDASDKYYADAVKG

SEQ ID NO: 642 - protein, 11 aa, Artificial Sequence
  source: /note="Description of Artificial Sequence: Synthetic peptide"
DLAIFGVVPDY

SEQ ID NO: 643 - DNA, 15 bp, Artificial Sequence
  source: /note="Description of Artificial Sequence: Synthetic oligonucleotide"
aactatggcatgcac

SEQ ID NO: 644 - DNA, 51 bp, Artificial Sequence; identical to SEQ ID NO: 362
  source: /note="Description of Artificial Sequence: Synthetic oligonucleotide"

SEQ ID NO: 645 - DNA, 33 bp, Artificial Sequence; identical to SEQ ID NO: 363
  source: /note="Description of Artificial Sequence: Synthetic oligonucleotide"

SEQ ID NO: 646 - protein, 5 aa, Artificial Sequence
  source: /note="Description of Artificial Sequence: Synthetic peptide"
NYGMH

SEQ ID NO: 647 - protein, 17 aa, Artificial Sequence
  source: /note="Description of Artificial Sequence: Synthetic peptide"
AIWFDASDKYYADAVKG

SEQ ID NO: 648 - protein, 11 aa, Artificial Sequence
  source: /note="Description of Artificial Sequence: Synthetic peptide"
DLAIFGVVPDY

SEQ ID NO: 649 - DNA, 15 bp, Artificial Sequence
  source: /note="Description of Artificial Sequence: Synthetic oligonucleotide"
aactatggcatgcac

SEQ ID NO: 650 - DNA, 51 bp, Artificial Sequence; identical to SEQ ID NO: 362
  source: /note="Description of Artificial Sequence: Synthetic oligonucleotide"

SEQ ID NO: 651 - DNA, 33 bp, Artificial Sequence; identical to SEQ ID NO: 489
  source: /note="Description of Artificial Sequence: Synthetic oligonucleotide"

SEQ ID NO: 652 - protein, 5 aa, Artificial Sequence
  source: /note="Description of Artificial Sequence: Synthetic peptide"
NYGMH

SEQ ID NO: 653 - protein, 17 aa, Artificial Sequence
  source: /note="Description of Artificial Sequence: Synthetic peptide"
AIWFDASDKYYADAVKG

SEQ ID NO: 654 - protein, 11 aa, Artificial Sequence
  source: /note="Description of Artificial Sequence: Synthetic peptide"
DIAIFGVVPDY

SEQ ID NO: 655 - DNA, 15 bp, Artificial Sequence
  source: /note="Description of Artificial Sequence: Synthetic oligonucleotide"
aactatggcatgcac

SEQ ID NO: 656 - DNA, 51 bp, Artificial Sequence; identical to SEQ ID NO: 362
  source: /note="Description of Artificial Sequence: Synthetic oligonucleotide"

SEQ ID NO: 657 - DNA, 33 bp, Artificial Sequence; identical to SEQ ID NO: 363
  source: /note="Description of Artificial Sequence: Synthetic oligonucleotide"

SEQ ID NO: 658 - protein, 5 aa, Artificial Sequence
  source: /note="Description of Artificial Sequence: Synthetic peptide"
NYGMH

SEQ ID NO: 659 - protein, 17 aa, Artificial Sequence
  source: /note="Description of Artificial Sequence: Synthetic peptide"
AIWFDASDKYYADAVKG

SEQ ID NO: 660 - protein, 11 aa, Artificial Sequence
  source: /note="Description of Artificial Sequence: Synthetic peptide"
DLAIFGVVPDY

SEQ ID NO: 661 - DNA, 15 bp, Artificial Sequence
  source: /note="Description of Artificial Sequence: Synthetic oligonucleotide"
aactatggcatgcac

SEQ ID NO: 662 - DNA, 51 bp, Artificial Sequence; identical to SEQ ID NO: 362
  source: /note="Description of Artificial Sequence: Synthetic oligonucleotide"

SEQ ID NO: 663 - DNA, 33 bp, Artificial Sequence; identical to SEQ ID NO: 489
  source: /note="Description of Artificial Sequence: Synthetic oligonucleotide"

SEQ ID NO: 664 - protein, 5 aa, Artificial Sequence
  source: /note="Description of Artificial Sequence: Synthetic peptide"
NYGMH

SEQ ID NO: 665 - protein, 17 aa, Artificial Sequence
  source: /note="Description of Artificial Sequence: Synthetic peptide"
AIWFDASDKYYADAVKG

SEQ ID NO: 666 - protein, 11 aa, Artificial Sequence
  source: /note="Description of Artificial Sequence: Synthetic peptide"
DIAIFGVVPDY

SEQ ID NO: 667 - DNA, 15 bp, Artificial Sequence
  source: /note="Description of Artificial Sequence: Synthetic oligonucleotide"
aactatggcatgcac

SEQ ID NO: 668 - DNA, 51 bp, Artificial Sequence
  source: /note="Description of Artificial Sequence: Synthetic oligonucleotide"
gctatatggtttgatgcgtacggtaaatactatgcagacgccgtgaagggc

SEQ ID NO: 669 - DNA, 33 bp, Artificial Sequence
  source: /note="Description of Artificial Sequence: Synthetic oligonucleotide"
gatcagacgatttttggagtggtccccgactac

SEQ ID NO: 670 - protein, 5 aa, Artificial Sequence
  source: /note="Description of Artificial Sequence: Synthetic peptide"
NYGMH

SEQ ID NO: 671 - protein, 17 aa, Artificial Sequence
  source: /note="Description of Artificial Sequence: Synthetic peptide"
AIWFDAYGKYYADAVKG

SEQ ID NO: 672 - protein, 11 aa, Artificial Sequence
  source: /note="Description of Artificial Sequence: Synthetic peptide"
DQTIFGVVPDY

SEQ ID NO: 673 - DNA, 15 bp, Artificial Sequence
  source: /note="Description of Artificial Sequence: Synthetic oligonucleotide"
aactatggcatgcac

SEQ ID NO: 674 - DNA, 51 bp, Artificial Sequence; identical to SEQ ID NO: 668
  source: /note="Description of Artificial Sequence: Synthetic oligonucleotide"

SEQ ID NO: 675 - DNA, 33 bp, Artificial Sequence; identical to SEQ ID NO: 669
  source: /note="Description of Artificial Sequence: Synthetic oligonucleotide"

SEQ ID NO: 676 - protein, 5 aa, Artificial Sequence
  source: /note="Description of Artificial Sequence: Synthetic peptide"
NYGMH

SEQ ID NO: 677 - protein, 17 aa, Artificial Sequence
  source: /note="Description of Artificial Sequence: Synthetic peptide"
AIWFDAYGKYYADAVKG

SEQ ID NO: 678 - protein, 11 aa, Artificial Sequence
  source: /note="Description of Artificial Sequence: Synthetic peptide"
DQTIFGVVPDY

SEQ ID NO: 679 - DNA, 15 bp, Artificial Sequence
  source: /note="Description of Artificial Sequence: Synthetic oligonucleotide"
aactatggcatgcac

SEQ ID NO: 680 - DNA, 51 bp, Artificial Sequence; identical to SEQ ID NO: 668
  source: /note="Description of Artificial Sequence: Synthetic oligonucleotide"

SEQ ID NO: 681 - DNA, 33 bp, Artificial Sequence
  source: /note="Description of Artificial Sequence: Synthetic oligonucleotide"
gataagacgatttttggagtggtccccgactac

SEQ ID NO: 682 - protein, 5 aa, Artificial Sequence
  source: /note="Description of Artificial Sequence: Synthetic peptide"
NYGMH

SEQ ID NO: 683 - protein, 17 aa, Artificial Sequence
  source: /note="Description of Artificial Sequence: Synthetic peptide"
AIWFDAYGKYYADAVKG

SEQ ID NO: 684 - protein, 11 aa, Artificial Sequence
  source: /note="Description of Artificial Sequence: Synthetic peptide"
DKTIFGVVPDY

SEQ ID NO: 685 - DNA, 15 bp, Artificial Sequence
  source: /note="Description of Artificial Sequence: Synthetic oligonucleotide"
aactatggcatgcac

SEQ ID NO: 686 - DNA, 51 bp, Artificial Sequence; identical to SEQ ID NO: 668
  source: /note="Description of Artificial Sequence: Synthetic oligonucleotide"

SEQ ID NO: 687 - DNA, 33 bp, Artificial Sequence; identical to SEQ ID NO: 681
  source: /note="Description of Artificial Sequence: Synthetic oligonucleotide"

SEQ ID NO: 688 - protein, 5 aa, Artificial Sequence
  source: /note="Description of Artificial Sequence: Synthetic peptide"
NYGMH

SEQ ID NO: 689 - protein, 17 aa, Artificial Sequence
  source: /note="Description of Artificial Sequence: Synthetic peptide"
AIWFDAYGKYYADAVKG

SEQ ID NO: 690 - protein, 11 aa, Artificial Sequence
  source: /note="Description of Artificial Sequence: Synthetic peptide"
DKTIFGVVPDY

SEQ ID NO: 691 - DNA, 15 bp, Artificial Sequence
  source: /note="Description of Artificial Sequence: Synthetic oligonucleotide"
aactatggcatgcac

SEQ ID NO: 692 - DNA, 51 bp, Artificial Sequence; identical to SEQ ID NO: 668
  source: /note="Description of Artificial Sequence: Synthetic oligonucleotide"

SEQ ID NO: 693 - DNA, 33 bp, Artificial Sequence; identical to SEQ ID NO: 681
  source: /note="Description of Artificial Sequence: Synthetic oligonucleotide"

SEQ ID NO: 694 - protein, 5 aa, Artificial Sequence
  source: /note="Description of Artificial Sequence: Synthetic peptide"
NYGMH

SEQ ID NO: 695 - protein, 17 aa, Artificial Sequence
  source: /note="Description of Artificial Sequence: Synthetic peptide"
AIWFDAYGKYYADAVKG

SEQ ID NO: 696 - protein, 11 aa, Artificial Sequence
  source: /note="Description of Artificial Sequence: Synthetic peptide"
DKTIFGVVPDY

SEQ ID NO: 697 - DNA, 15 bp, Artificial Sequence
  source: /note="Description of Artificial Sequence: Synthetic oligonucleotide"
aactatggcatgcac

SEQ ID NO: 698 - DNA, 51 bp, Artificial Sequence
  source: /note="Description of Artificial Sequence: Synthetic oligonucleotide"
gctatatggtttgatgcgtacgacaaatactatgcagacgccgtgaagggc

SEQ ID NO: 699 - DNA, 33 bp, Artificial Sequence
  source: /note="Description of Artificial Sequence: Synthetic oligonucleotide"
gataagtcgatttttggagtggtccccgactac

SEQ ID NO: 700 - protein, 5 aa, Artificial Sequence
  source: /note="Description of Artificial Sequence: Synthetic peptide"
NYGMH

SEQ ID NO: 701 - protein, 17 aa, Artificial Sequence
  source: /note="Description of Artificial Sequence: Synthetic peptide"
AIWFDAYDKYYADAVKG

SEQ ID NO: 702 - protein, 11 aa, Artificial Sequence
  source: /note="Description of Artificial Sequence: Synthetic peptide"
DKSIFGVVPDY

SEQ ID NO: 703 - DNA, 15 bp, Artificial Sequence
  source: /note="Description of Artificial Sequence: Synthetic oligonucleotide"
aactatggcatgcac

SEQ ID NO: 704 - DNA, 51 bp, Artificial Sequence; identical to SEQ ID NO: 698
  source: /note="Description of Artificial Sequence: Synthetic oligonucleotide"

SEQ ID NO: 705 - DNA, 33 bp, Artificial Sequence; identical to SEQ ID NO: 699
  source: /note="Description of Artificial Sequence: Synthetic oligonucleotide"

SEQ ID NO: 706 - protein, 5 aa, Artificial Sequence
  source: /note="Description of Artificial Sequence: Synthetic peptide"
NYGMH

SEQ ID NO: 707 - protein, 17 aa, Artificial Sequence
  source: /note="Description of Artificial Sequence: Synthetic peptide"
AIWFDAYDKYYADAVKG

SEQ ID NO: 708 - protein, 11 aa, Artificial Sequence
  source: /note="Description of Artificial Sequence: Synthetic peptide"
DKSIFGVVPDY

SEQ ID NO: 709 - DNA, 15 bp, Artificial Sequence
  source: /note="Description of Artificial Sequence: Synthetic oligonucleotide"
aactatggcatgcac

SEQ ID NO: 710 - DNA, 51 bp, Artificial Sequence; identical to SEQ ID NO: 698
  source: /note="Description of Artificial Sequence: Synthetic oligonucleotide"

SEQ ID NO: 711 - DNA, 33 bp, Artificial Sequence
  source: /note="Description of Artificial Sequence: Synthetic oligonucleotide"
gatctcgcgatttttggagtggtccccgactac

SEQ ID NO: 712 - protein, 5 aa, Artificial Sequence
  source: /note="Description of Artificial Sequence: Synthetic peptide"
NYGMH

SEQ ID NO: 713 - protein, 17 aa, Artificial Sequence
  source: /note="Description of Artificial Sequence: Synthetic peptide"
AIWFDAYDKYYADAVKG

SEQ ID NO: 714 - protein, 11 aa, Artificial Sequence
  source: /note="Description of Artificial Sequence: Synthetic peptide"
DLAIFGVVPDY

SEQ ID NO: 715 - DNA, 15 bp, Artificial Sequence
  source: /note="Description of Artificial Sequence: Synthetic oligonucleotide"
aactatggcatgcac

SEQ ID NO: 716 - DNA, 51 bp, Artificial Sequence
  source: /note="Description of Artificial Sequence: Synthetic oligonucleotide"
gctatatggtttgatgcggctttcaaatactatgcagacgccgtgaagggc

SEQ ID NO: 717 - DNA, 33 bp, Artificial Sequence; identical to SEQ ID NO: 711
  source: /note="Description of Artificial Sequence: Synthetic oligonucleotide"

SEQ ID NO: 718 - protein, 5 aa, Artificial Sequence
  source: /note="Description of Artificial Sequence: Synthetic peptide"
NYGMH

SEQ ID NO: 719 - protein, 17 aa, Artificial Sequence
  source: /note="Description of Artificial Sequence: Synthetic peptide"
AIWFDAAFKYYADAVKG

SEQ ID NO: 720 - protein, 11 aa, Artificial Sequence
  source: /note="Description of Artificial Sequence: Synthetic peptide"
DLAIFGVVPDY

SEQ ID NO: 721 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 722 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatttggcgatttttggagtggtccccgactactggggccagggaaccctggtcaccgtgtctagt

SEQ ID NO: 723 - protein, 107 aa, Artificial Sequence
  source: /note="Description of Artificial Sequence: Synthetic polypeptide"
EIVMTQSPATLSVSPGERATLSCRASQSVDRHLAWYQQKPGQAPRLLIYEAATRATGIPARFSGSGSGTEFTLTISSLQSEDFAVYYCQQYQNWPLTFGGGTKVEIK

SEQ ID NO: 724 - protein, 120 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVVPDYWGQGTLVTVSS

SEQ ID NO: 725 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaacagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 726 - DNA, 360 bp, Artificial Sequence; identical to SEQ ID NO: 722
  source: /note="Description of Artificial Sequence: Synthetic polynucleotide"

SEQ ID NO: 727 - protein, 107 aa, Artificial Sequence
  source: /note="Description of Artificial Sequence: Synthetic polypeptide"
EIVMTQSPATLSVSPGERATLSCRASQSVNRHLAWYQQKPGQAPRLLIYEAATRATGIPARFSGSGSGTEFTLTISSLQSEDFAVYYCQQYQNWPLTFGGGTKVEIK

SEQ ID NO: 728 - protein, 120 aa, Artificial Sequence; identical to SEQ ID NO: 724
  source: /note="Description of Artificial Sequence: Synthetic polypeptide"

SEQ ID NO: 729 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttcatagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 730 - DNA, 360 bp, Artificial Sequence; identical to SEQ ID NO: 722
  source: /note="Description of Artificial Sequence: Synthetic polynucleotide"

SEQ ID NO: 731 - protein, 107 aa, Artificial Sequence
  source: /note="Description of Artificial Sequence: Synthetic polypeptide"
EIVMTQSPATLSVSPGERATLSCRASQSVHRHLAWYQQKPGQAPRLLIYEAATRATGIPARFSGSGSGTEFTLTISSLQSEDFAVYYCQQYQNWPLTFGGGTKVEIK

SEQ ID NO: 732 - protein, 120 aa, Artificial Sequence; identical to SEQ ID NO: 724
  source: /note="Description of Artificial Sequence: Synthetic polypeptide"

SEQ ID NO: 733 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgaaagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 734 - DNA, 360 bp, Artificial Sequence; identical to SEQ ID NO: 722
  source: /note="Description of Artificial Sequence: Synthetic polynucleotide"

SEQ ID NO: 735 - protein, 107 aa, Artificial Sequence
  source: /note="Description of Artificial Sequence: Synthetic polypeptide"
EIVMTQSPATLSVSPGERATLSCRASQSVERHLAWYQQKPGQAPRLLIYEAATRATGIPARFSGSGSGTEFTLTISSLQSEDFAVYYCQQYQNWPLTFGGGTKVEIK

SEQ ID NO: 736 - protein, 120 aa, Artificial Sequence; identical to SEQ ID NO: 724
  source: /note="Description of Artificial Sequence: Synthetic polypeptide"

SEQ ID NO: 737 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 738 - DNA, 360 bp, Artificial Sequence; identical to SEQ ID NO: 722
  source: /note="Description of Artificial Sequence: Synthetic polynucleotide"

SEQ ID NO: 739 - protein, 107 aa, Artificial Sequence
  source: /note="Description of Artificial Sequence: Synthetic polypeptide"
EIVMTQSPATLSVSPGERATLSCRASQSVFRHLAWYQQKPGQAPRLLIYEAATRATGIPARFSGSGSGTEFTLTISSLQSEDFAVYYCQQYQNWPLTFGGGTKVEIK

SEQ ID NO: 740 - protein, 120 aa, Artificial Sequence; identical to SEQ ID NO: 724
  source: /note="Description of Artificial Sequence: Synthetic polypeptide"

SEQ ID NO: 741 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaacagacacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 742 - DNA, 360 bp, Artificial Sequence; identical to SEQ ID NO: 722
  source: /note="Description of Artificial Sequence: Synthetic polynucleotide"

SEQ ID NO: 743 - protein, 107 aa, Artificial Sequence
  source: /note="Description of Artificial Sequence: Synthetic polypeptide"
EIVMTQSPATLSVSPGERATLSCRASQSVNRHLAWYQQKPGQAPRLLIYEAATRATGIPARVSGSGSGTEFTLTISSLQSEDFAVYYCQQYQNWPLTFGGGTKVEIK

SEQ ID NO: 744 - protein, 120 aa, Artificial Sequence; identical to SEQ ID NO: 724
  source: /note="Description of Artificial Sequence: Synthetic polypeptide"

SEQ ID NO: 745 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgaaagacacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 746 - DNA, 360 bp, Artificial Sequence; identical to SEQ ID NO: 722
  source: /note="Description of Artificial Sequence: Synthetic polynucleotide"

SEQ ID NO: 747 - protein, 107 aa, Artificial Sequence
  source: /note="Description of Artificial Sequence: Synthetic polypeptide"
EIVMTQSPATLSVSPGERATLSCRASQSVERHLAWYQQKPGQAPRLLIYEAATRATGIPARVSGSGSGTEFTLTISSLQSEDFAVYYCQQYQNWPLTFGGGTKVEIK

SEQ ID NO: 748 - protein, 120 aa, Artificial Sequence; identical to SEQ ID NO: 724
  source: /note="Description of Artificial Sequence: Synthetic polypeptide"

SEQ ID NO: 749 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatagacacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 750 - DNA, 360 bp, Artificial Sequence; identical to SEQ ID NO: 722
  source: /note="Description of Artificial Sequence: Synthetic polynucleotide"

SEQ ID NO: 751 - protein, 107 aa, Artificial Sequence
  source: /note="Description of Artificial Sequence: Synthetic polypeptide"
EIVMTQSPATLSVSPGERATLSCRASQSVDRHLAWYQQKPGQAPRLLIYEAATRATGIPARVSGSGSGTEFTLTISSLQSEDFAVYYCQQYQNWPLTFGGGTKVEIK

SEQ ID NO: 752 - protein, 120 aa, Artificial Sequence; identical to SEQ ID NO: 724
  source: /note="Description of Artificial Sequence: Synthetic polypeptide"

SEQ ID NO: 753 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttctgagtcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataacaactggcctctcactttcggcggagggaccaaggtggagatcaaa

SEQ ID NO: 754 - DNA, 360 bp, Artificial Sequence; identical to SEQ ID NO: 722
  source: /note="Description of Artificial Sequence: Synthetic polynucleotide"

SEQ ID NO: 755 - protein, 107 aa, Artificial Sequence
  source: /note="Description of Artificial Sequence: Synthetic polypeptide"
EIVMTQSPATLSVSPGERATLSCRASQSVLSHLAWYQQKPGQAPRLLIYEAATRATGIPARFSGSGSGTEFTLTISSLQSEDFAVYYCQQYNNWPLTFGGGTKVEIK

SEQ ID NO: 756 - protein, 120 aa, Artificial Sequence; identical to SEQ ID NO: 724
  source: /note="Description of Artificial Sequence: Synthetic polypeptide"

SEQ ID NO: 757 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttctgagtcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 758 - DNA, 360 bp, Artificial Sequence; identical to SEQ ID NO: 722
  source: /note="Description of Artificial Sequence: Synthetic polynucleotide"

SEQ ID NO: 759 - protein, 107 aa, Artificial Sequence
  source: /note="Description of Artificial Sequence: Synthetic polypeptide"
EIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIK

SEQ ID NO: 760 - protein, 120 aa, Artificial Sequence; identical to SEQ ID NO: 724
  source: /note="Description of Artificial Sequence: Synthetic polypeptide"

SEQ ID NO: 761 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttatgagtcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 762 - DNA, 360 bp, Artificial Sequence; identical to SEQ ID NO: 722
  source: /note="Description of Artificial Sequence: Synthetic polynucleotide"

SEQ ID NO: 763 - protein, 107 aa, Artificial Sequence
  source: /note="Description of Artificial Sequence: Synthetic polypeptide"
EIVMTQSPATLSVSPGERATLSCRASQSVMSHLAWYQQKPGQAPRLLIYEAATRATGIPARFSGSGSGTEFTLTISSLQSEDFAVYYCQQYQNWPLTFGGGTKVEIK

SEQ ID NO: 764 - protein, 120 aa, Artificial Sequence; identical to SEQ ID NO: 724
  source: /note="Description of Artificial Sequence: Synthetic polypeptide"

SEQ ID NO: 765 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttctgacgcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 766 - DNA, 360 bp, Artificial Sequence; identical to SEQ ID NO: 722
  source: /note="Description of Artificial Sequence: Synthetic polynucleotide"

SEQ ID NO: 767 - protein, 107 aa, Artificial Sequence
  source: /note="Description of Artificial Sequence: Synthetic polypeptide"
EIVMTQSPATLSVSPGERATLSCRASQSVLTHLAWYQQKPGQAPRLLIYEAATRATGIPARFSGSGSGTEFTLTISSLQSEDFAVYYCQQYQNWPLTFGGGTKVEIK

SEQ ID NO: 768 - protein, 120 aa, Artificial Sequence; identical to SEQ ID NO: 724
  source: /note="Description of Artificial Sequence: Synthetic polypeptide"

SEQ ID NO: 769 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatctgcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 770 - DNA, 360 bp, Artificial Sequence; identical to SEQ ID NO: 722
  source: /note="Description of Artificial Sequence: Synthetic polynucleotide"

SEQ ID NO: 771 - protein, 107 aa, Artificial Sequence
  source: /note="Description of Artificial Sequence: Synthetic polypeptide"
EIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIK

SEQ ID NO: 772 - protein, 120 aa, Artificial Sequence; identical to SEQ ID NO: 724
  source: /note="Description of Artificial Sequence: Synthetic polypeptide"

SEQ ID NO: 773 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcgaacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 774 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatctggcgatttttggagtgattcccgactactggggccagggaaccctggtcaccgtgtctagt

SEQ ID NO: 775 - protein, 107 aa, Artificial Sequence
  source: /note="Description of Artificial Sequence: Synthetic polypeptide"
EIVMTQSPATLSVSPGERATLSCRASQSVSEHLAWYQQKPGQAPRLLIYEAATRATGIPARFSGSGSGTEFTLTISSLQSEDFAVYYCQQYQNWPLTFGGGTKVEIK

SEQ ID NO: 776 - protein, 120 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVIPDYWGQGTLVTVSS

SEQ ID NO: 777 - DNA, 321 bp, Artificial Sequence; identical to SEQ ID NO: 773
  source: /note="Description of Artificial Sequence: Synthetic polynucleotide"

SEQ ID NO: 778 - DNA, 360 bp, Artificial Sequence; identical to SEQ ID NO: 722
  source: /note="Description of Artificial Sequence: Synthetic polynucleotide"

SEQ ID NO: 779 - protein, 107 aa, Artificial Sequence; identical to SEQ ID NO: 775
  source: /note="Description of Artificial Sequence: Synthetic polypeptide"

SEQ ID NO: 780 - protein, 120 aa, Artificial Sequence; identical to SEQ ID NO: 724
  source: /note="Description of Artificial Sequence: Synthetic polypeptide"

SEQ ID NO: 781 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagccggcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagcactggcctctcactttcggcggagggaccaaggtggagatcaaa

SEQ ID NO: 782 - DNA, 360 bp, Artificial Sequence; identical to SEQ ID NO: 722
  source: /note="Description of Artificial Sequence: Synthetic polynucleotide"

SEQ ID NO: 783 - protein, 107 aa, Artificial Sequence
  source: /note="Description of Artificial Sequence: Synthetic polypeptide"
EIVMTQSPATLSVSPGERATLSCRASQSVSRHLAWYQQKPGQAPRLLIYEAATRATGIPARFSGSGSGTEFTLTISSLQSEDFAVYYCQQYQHWPLTFGGGTKVEIK

SEQ ID NO: 784 - protein, 120 aa, Artificial Sequence; identical to SEQ ID NO: 724
  source: /note="Description of Artificial Sequence: Synthetic polypeptide"

SEQ ID NO: 785 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcagccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 786 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttccagaactatggcatgcactgggtccgccaggctccaggcgaggggctggagtgggtggcagctatatggtttgatgcgtctgacaaatactatgcagacgccgtgaagggccgattcaccatctccagagacaactccaagaacacgctgtatctgcaaatgaacagcctgagagccgaggacacggctgtgtattactgtgcgagagatcttgcgatttttggagtggtccccgactactggggccagggaaccctggtcaccgtgtctagt

SEQ ID NO: 787 - protein, 107 aa, Artificial Sequence
  source: /note="Description of Artificial Sequence: Synthetic polypeptide"
EIVMTQSPATLSVSPGERATLSCRASQSVFSHLAWYQQKPGQAPRLLIYEAATRATGIPARFSGSGSGTEFTLTISSLQSEDFAVYYCQQYQNWPLTFGGGTKVEIK

SEQ ID NO: 788 - protein, 120 aa, Artificial Sequence
  source: /note="Description of Artificial Sequence: Synthetic polypeptide"
QVQLVESGGGVVQPGRSLRLSCAASGFTFQNYGMHWVRQAPGEGLEWVAAIWFDASDKYYADAVKGRFTISRDNSKNTLYLQMNSLRAEDTAVYYCARDLAIFGVVPDYWGQGTLVTVSS

SEQ ID NO: 789 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcagccacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 790 - DNA, 360 bp, Artificial Sequence; identical to SEQ ID NO: 786
  source: /note="Description of Artificial Sequence: Synthetic polynucleotide"

SEQ ID NO: 791 - protein, 107 aa, Artificial Sequence
  source: /note="Description of Artificial Sequence: Synthetic polypeptide"
EIVMTQSPATLSVSPGERATLSCRASQSVFSHLAWYQQKPGQAPRLLIYEAATRATGIPARVSGSGSGTEFTLTISSLQSEDFAVYYCQQYQNWPLTFGGGTKVEIK

SEQ ID NO: 792 - protein, 120 aa, Artificial Sequence; identical to SEQ ID NO: 788
  source: /note="Description of Artificial Sequence: Synthetic polypeptide"

SEQ ID NO: 793 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttctgagtcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagcagtggcctctcactttcggcggagggaccaaggtggagatcaaa

SEQ ID NO: 794 - DNA, 360 bp, Artificial Sequence; identical to SEQ ID NO: 786
  source: /note="Description of Artificial Sequence: Synthetic polynucleotide"

SEQ ID NO: 795 - protein, 107 aa, Artificial Sequence
  source: /note="Description of Artificial Sequence: Synthetic polypeptide"
EIVMTQSPATLSVSPGERATLSCRASQSVLSHLAWYQQKPGQAPRLLIYEAATRATGIPARFSGSGSGTEFTLTISSLQSEDFAVYYCQQYQQWPLTFGGGTKVEIK

SEQ ID NO: 796 - protein, 120 aa, Artificial Sequence; identical to SEQ ID NO: 788
  source: /note="Description of Artificial Sequence: Synthetic polypeptide"

SEQ ID NO: 797 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcagccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagcagtggcctctcactttcggcggagggaccaaggtggagatcaaa

SEQ ID NO: 798 - DNA, 360 bp, Artificial Sequence; identical to SEQ ID NO: 722
  source: /note="Description of Artificial Sequence: Synthetic polynucleotide"

SEQ ID NO: 799 - protein, 107 aa, Artificial Sequence
  source: /note="Description of Artificial Sequence: Synthetic polypeptide"
EIVMTQSPATLSVSPGERATLSCRASQSVFSHLAWYQQKPGQAPRLLIYEAATRATGIPARFSGSGSGTEFTLTISSLQSEDFAVYYCQQYQQWPLTFGGGTKVEIK

SEQ ID NO: 800 - protein, 120 aa, Artificial Sequence; identical to SEQ ID NO: 724
  source: /note="Description of Artificial Sequence: Synthetic polypeptide"

SEQ ID NO: 801 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcagccacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtatcagcagtggcctctcactttcggcggagggaccaaggtggagatcaaa

SEQ ID NO: 802 - DNA, 360 bp, Artificial Sequence; identical to SEQ ID NO: 722
  source: /note="Description of Artificial Sequence: Synthetic polynucleotide"

SEQ ID NO: 803 - protein, 107 aa, Artificial Sequence
  source: /note="Description of Artificial Sequence: Synthetic polypeptide"
EIVMTQSPATLSVSPGERATLSCRASQSVFSHLAWYQQKPGQAPRLLIYEAATRATGIPARVSGSGSGTEFTLTISSLQSEDFAVYYCQQYQQWPLTFGGGTKVEIK

SEQ ID NO: 804 - protein, 120 aa, Artificial Sequence; identical to SEQ ID NO: 724
  source: /note="Description of Artificial Sequence: Synthetic polypeptide"

SEQ ID NO: 805 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttcagagccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 806 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatattgcgatttttggagtggtccccgactactggggccagggaaccctggtcaccgtgtctagt

SEQ ID NO: 807 - protein, 107 aa, Artificial Sequence
  source: /note="Description of Artificial Sequence: Synthetic polypeptide"
EIVMTQSPATLSVSPGERATLSCRASQSVQSHLAWYQQKPGQAPRLLIYEAATRATGIPARFSGSGSGTEFTLTISSLQSEDFAVYYCQQYQNWPLTFGGGTKVEIK

SEQ ID NO: 808 - protein, 120 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDIAIFGVVPDYWGQGTLVTVSS

SEQ ID NO: 809 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagtagccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagcagtggcctctcactttcggcggagggaccaaggtggagatcaaa

SEQ ID NO: 810 - DNA, 360 bp, Artificial Sequence; identical to SEQ ID NO: 806
  source: /note="Description of Artificial Sequence: Synthetic polynucleotide"

SEQ ID NO: 811 - protein, 107 aa, Artificial Sequence
  source: /note="Description of Artificial Sequence: Synthetic polypeptide"
EIVMTQSPATLSVSPGERATLSCRASQSVSSHLAWYQQKPGQAPRLLIYEAATRATGIPARFSGSGSGTEFTLTISSLQSEDFAVYYCQQYQQWPLTFGGGTKVEIK

SEQ ID NO: 812 - protein, 120 aa, Artificial Sequence; identical to SEQ ID NO: 808
  source: /note="Description of Artificial Sequence: Synthetic polypeptide"

SEQ ID NO: 813 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcacgcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataacaactggcctctcactttcggcggagggaccaaggtggagatcaaa

SEQ ID NO: 814 - DNA, 360 bp, Artificial Sequence; identical to SEQ ID NO: 722
  source: /note="Description of Artificial Sequence: Synthetic polynucleotide"

SEQ ID NO: 815 - protein, 107 aa, Artificial Sequence
  source: /note="Description of Artificial Sequence: Synthetic polypeptide"
EIVMTQSPATLSVSPGERATLSCRASQSVFTHLAWYQQKPGQAPRLLIYEAATRATGIPARFSGSGSGTEFTLTISSLQSEDFAVYYCQQYNNWPLTFGGGTKVEIK

SEQ ID NO: 816 - protein, 120 aa, Artificial Sequence; identical to SEQ ID NO: 724
  source: /note="Description of Artificial Sequence: Synthetic polypeptide"

SEQ ID NO: 817 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcacgcacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtataacaactggcctctcactttcggcggagggaccaaggtggagatcaaa

SEQ ID NO: 818 - DNA, 360 bp, Artificial Sequence; identical to SEQ ID NO: 722
  source: /note="Description of Artificial Sequence: Synthetic polynucleotide"

SEQ ID NO: 819 - protein, 107 aa, Artificial Sequence
  source: /note="Description of Artificial Sequence: Synthetic polypeptide"
EIVMTQSPATLSVSPGERATLSCRASQSVFTHLAWYQQKPGQAPRLLIYEAATRATGIPARVSGSGSGTEFTLTISSLQSEDFAVYYCQQYNNWPLTFGGGTKVEIK

SEQ ID NO: 820 - protein, 120 aa, Artificial Sequence; identical to SEQ ID NO: 724
  source: /note="Description of Artificial Sequence: Synthetic polypeptide"

SEQ ID NO: 821 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgtttttgaacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataacaactggcctctcactttcggcggagggaccaaggtggagatcaaa

SEQ ID NO: 822 - DNA, 360 bp, Artificial Sequence; identical to SEQ ID NO: 722
  source: /note="Description of Artificial Sequence: Synthetic polynucleotide"

SEQ ID NO: 823 - protein, 107 aa, Artificial Sequence
  source: /note="Description of Artificial Sequence: Synthetic polypeptide"
EIVMTQSPATLSVSPGERATLSCRASQSVFEHLAWYQQKPGQAPRLLIYEAATRATGIPARFSGSGSGTEFTLTISSLQSEDFAVYYCQQYNNWPLTFGGGTKVEIK

SEQ ID NO: 824 - protein, 120 aa, Artificial Sequence; identical to SEQ ID NO: 724
  source: /note="Description of Artificial Sequence: Synthetic polypeptide"

SEQ ID NO: 825 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgaacagcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataacaactggcctctcactttcggcggagggaccaaggtggagatcaaa

SEQ ID NO: 826 - DNA, 360 bp, Artificial Sequence; identical to SEQ ID NO: 722
  source: /note="Description of Artificial Sequence: Synthetic polynucleotide"

SEQ ID NO: 827 - protein, 107 aa, Artificial Sequence
  source: /note="Description of Artificial Sequence: Synthetic polypeptide"
EIVMTQSPATLSVSPGERATLSCRASQSVEQHLAWYQQKPGQAPRLLIYEAATRATGIPARFSGSGSGTEFTLTISSLQSEDFAVYYCQQYNNWPLTFGGGTKVEIK

SEQ ID NO: 828 - protein, 120 aa, Artificial Sequence; identical to SEQ ID NO: 724
  source: /note="Description of Artificial Sequence: Synthetic polypeptide"

SEQ ID NO: 829 - DNA, 321 bp, Artificial Sequence
  source: /note="Description of Artificial Sequence: Synthetic polynucleotide"
gaaatagtgatgacgcagtctccggccaccctgtctgtgtctccaggggaaagagccaccctctcctgcagggccagtcagagtgttcatagccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaa

SEQ ID NO: 830 - DNA, 360 bp, Artificial Sequence; identical to SEQ ID NO: 722
  source: /note="Description of Artificial Sequence: Synthetic polynucleotide"

SEQ ID NO: 831 - protein, 107 aa, Artificial Sequence
  source: /note="Description of Artificial Sequence: Synthetic polypeptide"
EIVMTQSPATLSVSPGERATLSCRASQSVHSHLAWYQQKPGQAPRLLIYEAATRATGIPARFSGSGSGTEFTLTISSLQSEDFAVYYCQQYNQWPLTFGGGTKVEIK

SEQ ID NO: 832 - protein, 120 aa, Artificial Sequence; identical to SEQ ID NO: 724
  source: /note="Description of Artificial Sequence: Synthetic polypeptide"

SEQ ID NO: 833 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttcatcatcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaa

SEQ ID NO: 834 - DNA, 360 bp, Artificial Sequence; identical to SEQ ID NO: 722
  source: /note="Description of Artificial Sequence: Synthetic polynucleotide"

SEQ ID NO: 835 - protein, 107 aa, Artificial Sequence
  source: /note="Description of Artificial Sequence: Synthetic polypeptide"
EIVMTQSPATLSVSPGERATLSCRASQSVHHHLAWYQQKPGQAPRLLIYEAATRATGIPARFSGSGSGTEFTLTISSLQSEDFAVYYCQQYNQWPLTFGGGTKVEIK

SEQ ID NO: 836 - protein, 120 aa, Artificial Sequence; identical to SEQ ID NO: 724
  source: /note="Description of Artificial Sequence: Synthetic polypeptide"

SEQ ID NO: 837 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttcatagccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataacaactggcctctcactttcggcggagggaccaaggtggagatcaaa

SEQ ID NO: 838 - DNA, 360 bp, Artificial Sequence; identical to SEQ ID NO: 722
  source: /note="Description of Artificial Sequence: Synthetic polynucleotide"

SEQ ID NO: 839 - protein, 107 aa, Artificial Sequence
  source: /note="Description of Artificial Sequence: Synthetic polypeptide"
EIVMTQSPATLSVSPGERATLSCRASQSVHSHLAWYQQKPGQAPRLLIYEAATRATGIPARFSGSGSGTEFTLTISSLQSEDFAVYYCQQYNNWPLTFGGGTKVEIK

SEQ ID NO: 840 - protein, 120 aa, Artificial Sequence; identical to SEQ ID NO: 724
  source: /note="Description of Artificial Sequence: Synthetic polypeptide"

SEQ ID NO: 841 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatgtcaacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaa

SEQ ID NO: 842 - DNA, 360 bp, Artificial Sequence; identical to SEQ ID NO: 722
  source: /note="Description of Artificial Sequence: Synthetic polynucleotide"

SEQ ID NO: 843 - protein, 107 aa, Artificial Sequence
  source: /note="Description of Artificial Sequence: Synthetic polypeptide"
EIVMTQSPATLSVSPGERATLSCRASQSVDVNLAWYQQKPGQAPRLLIYEAATRATGIPARFSGSGSGTEFTLTISSLQSEDFAVYYCQQYNQWPLTFGGGTKVEIK

SEQ ID NO: 844 - protein, 120 aa, Artificial Sequence; identical to SEQ ID NO: 724
  source: /note="Description of Artificial Sequence: Synthetic polypeptide"

SEQ ID NO: 845 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatgtccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaa

SEQ ID NO: 846 - DNA, 360 bp, Artificial Sequence; identical to SEQ ID NO: 722
  source: /note="Description of Artificial Sequence: Synthetic polynucleotide"

SEQ ID NO: 847 - protein, 107 aa, Artificial Sequence
  source: /note="Description of Artificial Sequence: Synthetic polypeptide"
EIVMTQSPATLSVSPGERATLSCRASQSVDVHLAWYQQKPGQAPRLLIYEAATRATGIPARFSGSGSGTEFTLTISSLQSEDFAVYYCQQYNQWPLTFGGGTKVEIK

SEQ ID NO: 848 - protein, 120 aa, Artificial Sequence; identical to SEQ ID NO: 724
  source: /note="Description of Artificial Sequence: Synthetic polypeptide"

SEQ ID NO: 849 - DNA, 321 bp, Artificial Sequence; identical to SEQ ID NO: 821
  source: /note="Description of Artificial Sequence: Synthetic polynucleotide"

SEQ ID NO: 850 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatattgcgatttttggagtgtttcccgactactggggccagggaaccctggtcaccgtgtctagt

SEQ ID NO: 851 - protein, 107 aa, Artificial Sequence; identical to SEQ ID NO: 823
  source: /note="Description of Artificial Sequence: Synthetic polypeptide"

SEQ ID NO: 852 - protein, 120 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDIAIFGVFPDYWGQGTLVTVSS

SEQ ID NO: 853 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgtttttgaacacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtataacaactggcctctcactttcggcggagggaccaaggtggagatcaaa

SEQ ID NO: 854 - DNA, 360 bp, Artificial Sequence; identical to SEQ ID NO: 850
  source: /note="Description of Artificial Sequence: Synthetic polynucleotide"

SEQ ID NO: 855 - protein, 107 aa, Artificial Sequence
  source: /note="Description of Artificial Sequence: Synthetic polypeptide"
EIVMTQSPATLSVSPGERATLSCRASQSVFEHLAWYQQKPGQAPRLLIYEAATRATGIPARVSGSGSGTEFTLTISSLQSEDFAVYYCQQYNNWPLTFGGGTKVEIK

SEQ ID NO: 856 - protein, 120 aa, Artificial Sequence; identical to SEQ ID NO: 852
  source: /note="Description of Artificial Sequence: Synthetic polypeptide"

SEQ ID NO: 857 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcgaacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaa

SEQ ID NO: 858 - DNA, 360 bp, Artificial Sequence; identical to SEQ ID NO: 806
  source: /note="Description of Artificial Sequence: Synthetic polynucleotide"

SEQ ID NO: 859 - protein, 107 aa, Artificial Sequence
  source: /note="Description of Artificial Sequence: Synthetic polypeptide"
EIVMTQSPATLSVSPGERATLSCRASQSVFEHLAWYQQKPGQAPRLLIYEAATRATGIPARFSGSGSGTEFTLTISSLQSEDFAVYYCQQYNQWPLTFGGGTKVEIK

SEQ ID NO: 860 - protein, 120 aa, Artificial Sequence; identical to SEQ ID NO: 808
  source: /note="Description of Artificial Sequence: Synthetic polypeptide"

SEQ ID NO: 861 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttctggaacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataacaactggcctctcactttcggcggagggaccaaggtggagatcaaa

SEQ ID NO: 862 - DNA, 360 bp, Artificial Sequence; identical to SEQ ID NO: 806
  source: /note="Description of Artificial Sequence: Synthetic polynucleotide"

SEQ ID NO: 863 - protein, 107 aa, Artificial Sequence
  source: /note="Description of Artificial Sequence: Synthetic polypeptide"
EIVMTQSPATLSVSPGERATLSCRASQSVLEHLAWYQQKPGQAPRLLIYEAATRATGIPARFSGSGSGTEFTLTISSLQSEDFAVYYCQQYNNWPLTFGGGTKVEIK

SEQ ID NO: 864 - protein, 120 aa, Artificial Sequence; identical to SEQ ID NO: 808
  source: /note="Description of Artificial Sequence: Synthetic polypeptide"

SEQ ID NO: 865 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaa

SEQ ID NO: 866 - DNA, 360 bp, Artificial Sequence; identical to SEQ ID NO: 850
  source: /note="Description of Artificial Sequence: Synthetic polynucleotide"

SEQ ID NO: 867 - protein, 107 aa, Artificial Sequence
  source: /note="Description of Artificial Sequence: Synthetic polypeptide"
EIVMTQSPATLSVSPGERATLSCRASQSVDRHLAWYQQKPGQAPRLLIYEAATRATGIPARFSGSGSGTEFTLTISSLQSEDFAVYYCQQYNQWPLTFGGGTKVEIK

SEQ ID NO: 868 - protein, 120 aa, Artificial Sequence; identical to SEQ ID NO: 852
  source: /note="Description of Artificial Sequence: Synthetic polypeptide"

SEQ ID NO: 869 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaaccggcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagcagtggcctctcactttcggcggagggaccaaggtggagatcaaa

SEQ ID NO: 870 - DNA, 360 bp, Artificial Sequence; identical to SEQ ID NO: 850
  source: /note="Description of Artificial Sequence: Synthetic polynucleotide"

SEQ ID NO: 871 - protein, 107 aa, Artificial Sequence
  source: /note="Description of Artificial Sequence: Synthetic polypeptide"
EIVMTQSPATLSVSPGERATLSCRASQSVNRHLAWYQQKPGQAPRLLIYEAATRATGIPARFSGSGSGTEFTLTISSLQSEDFAVYYCQQYQQWPLTFGGGTKVEIK

SEQ ID NO: 872 - protein, 120 aa, Artificial Sequence; identical to SEQ ID NO: 852
  source: /note="Description of Artificial Sequence: Synthetic polypeptide"

SEQ ID NO: 873 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaacgtacacttagcctggtaccagcagaaacctggccaggctcccaggctcctcatctaccaggcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaa

SEQ ID NO: 874 - DNA, 360 bp, Artificial Sequence; identical to SEQ ID NO: 850
  source: /note="Description of Artificial Sequence: Synthetic polynucleotide"

SEQ ID NO: 875 - protein, 107 aa, Artificial Sequence
  source: /note="Description of Artificial Sequence: Synthetic polypeptide"
EIVMTQSPATLSVSPGERATLSCRASQSVNVHLAWYQQKPGQAPRLLIYQAATRATGIPARFSGSGSGTEFTLTISSLQSEDFAVYYCQQYNQWPLTFGGGTKVEIK

SEQ ID NO: 876 - protein, 120 aa, Artificial Sequence; identical to SEQ ID NO: 852
  source: /note="Description of Artificial Sequence: Synthetic polypeptide"

SEQ ID NO: 877 - DNA, 321 bp, Artificial Sequence; identical to SEQ ID NO: 765
  source: /note="Description of Artificial Sequence: Synthetic polynucleotide"

SEQ ID NO: 878 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatattgcgatttttggagtgatccccgactactggggccagggaaccctggtcaccgtgtctagt

SEQ ID NO: 879 - protein, 107 aa, Artificial Sequence; identical to SEQ ID NO: 767
  source: /note="Description of Artificial Sequence: Synthetic polypeptide"

SEQ ID NO: 880 - protein, 120 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDIAIFGVIPDYWGQGTLVTVSS

SEQ ID NO: 881 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttctgacgcacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 882 - DNA, 360 bp, Artificial Sequence; identical to SEQ ID NO: 878
  source: /note="Description of Artificial Sequence: Synthetic polynucleotide"

SEQ ID NO: 883 - protein, 107 aa, Artificial Sequence
  source: /note="Description of Artificial Sequence: Synthetic polypeptide"
EIVMTQSPATLSVSPGERATLSCRASQSVLTHLAWYQQKPGQAPRLLIYEAATRATGIPARVSGSGSGTEFTLTISSLQSEDFAVYYCQQYQNWPLTFGGGTKVEIK

SEQ ID NO: 884 - protein, 120 aa, Artificial Sequence; identical to SEQ ID NO: 880
  source: /note="Description of Artificial Sequence: Synthetic polypeptide"

SEQ ID NO: 885 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctgcagtctgaagattttgcagtttattactgtcagcagtataataactggcctctcactttcggcggagggaccaaggtggagatcaaa

SEQ ID NO: 886 - DNA, 360 bp, Artificial Sequence; identical to SEQ ID NO: 722
  source: /note="Description of Artificial Sequence: Synthetic polynucleotide"

SEQ ID NO: 887 - protein, 107 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIK

SEQ ID NO: 888 - protein, 120 aa, Artificial Sequence; identical to SEQ ID NO: 724
  source: /note="Description of Artificial Sequence: Synthetic polypeptide"

SEQ ID NO: 889 - DNA, 321 bp, Artificial Sequence; identical to SEQ ID NO: 885
  source: /note="Description of Artificial Sequence: Synthetic polynucleotide"

SEQ ID NO: 890 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgattactggggccagggaaccctggtcaccgtgtctagt

SEQ ID NO: 891 - protein, 107 aa, Artificial Sequence; identical to SEQ ID NO: 887
  source: /note="Description of Artificial Sequence: Synthetic polypeptide"

SEQ ID NO: 892 - protein, 120 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSS

SEQ ID NO: 893 - DNA, 321 bp, Artificial Sequence; identical to SEQ ID NO: 885
  source: /note="Description of Artificial Sequence: Synthetic polynucleotide"

SEQ ID NO: 894 - DNA, 360 bp, Artificial Sequence; identical to SEQ ID NO: 806
  source: /note="Description of Artificial Sequence: Synthetic polynucleotide"

SEQ ID NO: 895 - protein, 107 aa, Artificial Sequence; identical to SEQ ID NO: 887
  source: /note="Description of Artificial Sequence: Synthetic polypeptide"

SEQ ID NO: 896 - protein, 120 aa, Artificial Sequence; identical to SEQ ID NO: 808
  source: /note="Description of Artificial Sequence: Synthetic polypeptide"

SEQ ID NO: 897 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccagggtcagtggcagtgggtctgggacagagttcactctcaccatcagcagcctgcagtctgaagattttgcagtttattactgtcagcagtataataactggcctctcactttcggcggagggaccaaggtggagatcaaa

SEQ ID NO: 898 - DNA, 360 bp, Artificial Sequence; identical to SEQ ID NO: 722
  source: /note="Description of Artificial Sequence: Synthetic polynucleotide"

SEQ ID NO: 899 - protein, 107 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIK

SEQ ID NO: 900 - protein, 120 aa, Artificial Sequence; identical to SEQ ID NO: 724
  source: /note="Description of Artificial Sequence: Synthetic polypeptide"

SEQ ID NO: 901 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatgaagcagccaccagggccactggtatcccagccagggtcagtggcagtgggtctgggacagagttcactctcaccatcagcagcctgcagtctgaagattttgcagtttattactgtcagcagtataataactggcctctcactttcggcggagggaccaaggtggagatcaaa

SEQ ID NO: 902 - DNA, 360 bp, Artificial Sequence; identical to SEQ ID NO: 890
  source: /note="Description of Artificial Sequence: Synthetic polynucleotide"

SEQ ID NO: 903 - protein, 107 aa, Artificial Sequence
  source: /note="Description of Artificial Sequence: Synthetic polypeptide"
EIVMTQSPATLSVSPGERATLSCRASQSVSSNLAWYQQKPGQAPRLLIYEAATRATGIPARVSGSGSGTEFTLTISSLQSEDFAVYYCQQYNNWPLTFGGGTKVEIK

SEQ ID NO: 904 - protein, 120 aa, Artificial Sequence; identical to SEQ ID NO: 892
  source: /note="Description of Artificial Sequence: Synthetic polypeptide"

SEQ ID NO: 905 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatgttaacttagcctggtaccagcagaaacctggccaggctcccaggctcctcatctacaacgcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 906 - DNA, 360 bp, Artificial Sequence; identical to SEQ ID NO: 722
  source: /note="Description of Artificial Sequence: Synthetic polynucleotide"

SEQ ID NO: 907 - protein, 107 aa, Artificial Sequence
  source: /note="Description of Artificial Sequence: Synthetic polypeptide"
EIVMTQSPATLSVSPGERATLSCRASQSVDVNLAWYQQKPGQAPRLLIYNAATRATGIPARFSGSGSGTEFTLTISSLQSEDFAVYYCQQYQNWPLTFGGGTKVEIK

SEQ ID NO: 908 - protein, 120 aa, Artificial Sequence; identical to SEQ ID NO: 724
  source: /note="Description of Artificial Sequence: Synthetic polypeptide"

SEQ ID NO: 909 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatgttaacttagcctggtaccagcagaaacctggccaggctcccaggctcctcatctacaacgcagccaccagggccactggtatcccagccagggtcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 910 - DNA, 360 bp, Artificial Sequence; identical to SEQ ID NO: 722
  source: /note="Description of Artificial Sequence: Synthetic polynucleotide"

SEQ ID NO: 911 - protein, 107 aa, Artificial Sequence
  source: /note="Description of Artificial Sequence: Synthetic polypeptide"
EIVMTQSPATLSVSPGERATLSCRASQSVDVNLAWYQQKPGQAPRLLIYNAATRATGIPARVSGSGSGTEFTLTISSLQSEDFAVYYCQQYQNWPLTFGGGTKVEIK

SEQ ID NO: 912 - protein, 120 aa, Artificial Sequence; identical to SEQ ID NO: 724
  source: /note="Description of Artificial Sequence: Synthetic polypeptide"

SEQ ID NO: 913 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttcatacgaacttagcctggtaccagcagaaacctggccaggctcccaggctcctcatctacaacgcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 914 - DNA, 360 bp, Artificial Sequence; identical to SEQ ID NO: 806
  source: /note="Description of Artificial Sequence: Synthetic polynucleotide"

SEQ ID NO: 915 - protein, 107 aa, Artificial Sequence
  source: /note="Description of Artificial Sequence: Synthetic polypeptide"
EIVMTQSPATLSVSPGERATLSCRASQSVHTNLAWYQQKPGQAPRLLIYNAATRATGIPARFSGSGSGTEFTLTISSLQSEDFAVYYCQQYQNWPLTFGGGTKVEIK

SEQ ID NO: 916 - protein, 120 aa, Artificial Sequence; identical to SEQ ID NO: 808
  source: /note="Description of Artificial Sequence: Synthetic polypeptide"

SEQ ID NO: 917 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaacctgaacttagcctggtaccagcagaaacctggccaggctcccaggctcctcatctaccaggcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaa

SEQ ID NO: 918 - DNA, 360 bp, Artificial Sequence; identical to SEQ ID NO: 722
  source: /note="Description of Artificial Sequence: Synthetic polynucleotide"

SEQ ID NO: 919 - protein, 107 aa, Artificial Sequence
  source: /note="Description of Artificial Sequence: Synthetic polypeptide"
EIVMTQSPATLSVSPGERATLSCRASQSVNLNLAWYQQKPGQAPRLLIYQAATRATGIPARFSGSGSGTEFTLTISSLQSEDFAVYYCQQYNQWPLTFGGGTKVEIK

SEQ ID NO: 920 - protein, 120 aa, Artificial Sequence; identical to SEQ ID NO: 724
  source: /note="Description of Artificial Sequence: Synthetic polypeptide"

SEQ ID NO: 921 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttccagaacttagcctggtaccagcagaaacctggccaggctcccaggctcctcatctaccaggcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaa

SEQ ID NO: 922 - DNA, 360 bp, Artificial Sequence; identical to SEQ ID NO: 806
  source: /note="Description of Artificial Sequence: Synthetic polynucleotide"

SEQ ID NO: 923 - protein, 107 aa, Artificial Sequence
  source: /note="Description of Artificial Sequence: Synthetic polypeptide"
EIVMTQSPATLSVSPGERATLSCRASQSVFQNLAWYQQKPGQAPRLLIYQAATRATGIPARFSGSGSGTEFTLTISSLQSEDFAVYYCQQYNQWPLTFGGGTKVEIK

SEQ ID NO: 924 - protein, 120 aa, Artificial Sequence; identical to SEQ ID NO: 808
  source: /note="Description of Artificial Sequence: Synthetic polypeptide"

SEQ ID NO: 925 - DNA, 321 bp, Artificial Sequence; identical to SEQ ID NO: 865
  source: /note="Description of Artificial Sequence: Synthetic polynucleotide"

SEQ ID NO: 926 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttccagaactatggcatgcactgggtccgccaggctccaggcgaggggctggagtgggtggcagctatatggtttgatgcgtacggtaaatactatgcagacgccgtgaagggccgattcaccatctccagagacaactccaagaacacgctgtatctgcaaatgaacagcctgagagccgaggacacggctgtgtattactgtgcgagagatcagacgatttttggagtggtccccgactactggggccagggaaccctggtcaccgtgtctagt

SEQ ID NO: 927 - protein, 107 aa, Artificial Sequence; identical to SEQ ID NO: 867
  source: /note="Description of Artificial Sequence: Synthetic polypeptide"

SEQ ID NO: 928 - protein, 120 aa, Artificial Sequence
  source: /note="Description of Artificial Sequence: Synthetic polypeptide"
QVQLVESGGGVVQPGRSLRLSCAASGFTFQNYGMHWVRQAPGEGLEWVAAIWFDAYGKYYADAVKGRFTISRDNSKNTLYLQMNSLRAEDTAVYYCARDQTIFGVVPDYWGQGTLVTVSS

SEQ ID NO: 929 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatagacacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtataaccagtggcctctcactttcggcggagggaccaaggtggagatcaaa

SEQ ID NO: 930 - DNA, 360 bp, Artificial Sequence; identical to SEQ ID NO: 926
  source: /note="Description of Artificial Sequence: Synthetic polynucleotide"

SEQ ID NO: 931 - protein, 107 aa, Artificial Sequence
  source: /note="Description of Artificial Sequence: Synthetic polypeptide"
EIVMTQSPATLSVSPGERATLSCRASQSVDRHLAWYQQKPGQAPRLLIYEAATRATGIPARVSGSGSGTEFTLTISSLQSEDFAVYYCQQYNQWPLTFGGGTKVEIK

SEQ ID NO: 932 - protein, 120 aa, Artificial Sequence; identical to SEQ ID NO: 928
  source: /note="Description of Artificial Sequence: Synthetic polypeptide"

SEQ ID NO: 933 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaaccggcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaa

SEQ ID NO: 934 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttccagaactatggcatgcactgggtccgccaggctccaggcgaggggctggagtgggtggcagctatatggtttgatgcgtacggtaaatactatgcagacgccgtgaagggccgattcaccatctccagagacaactccaagaacacgctgtatctgcaaatgaacagcctgagagccgaggacacggctgtgtattactgtgcgagagataagacgatttttggagtggtccccgactactggggccagggaaccctggtcaccgtgtctagt

SEQ ID NO: 935 - protein, 107 aa, Artificial Sequence
  source: /note="Description of Artificial Sequence: Synthetic polypeptide"
EIVMTQSPATLSVSPGERATLSCRASQSVNRHLAWYQQKPGQAPRLLIYEAATRATGIPARFSGSGSGTEFTLTISSLQSEDFAVYYCQQYNQWPLTFGGGTKVEIK

SEQ ID NO: 936 - protein, 120 aa, Artificial Sequence
  source: /note="Description of Artificial Sequence: Synthetic polypeptide"
QVQLVESGGGVVQPGRSLRLSCAASGFTFQNYGMHWVRQAPGEGLEWVAAIWFDAYGKYYADAVKGRFTISRDNSKNTLYLQMNSLRAEDTAVYYCARDKTIFGVVPDYWGQGTLVTVSS

SEQ ID NO: 937 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgaaagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagcagtggcctctcactttcggcggagggaccaaggtggagatcaaa

SEQ ID NO: 938 - DNA, 360 bp, Artificial Sequence; identical to SEQ ID NO: 934
  source: /note="Description of Artificial Sequence: Synthetic polynucleotide"

SEQ ID NO: 939 - protein, 107 aa, Artificial Sequence
  source: /note="Description of Artificial Sequence: Synthetic polypeptide"
EIVMTQSPATLSVSPGERATLSCRASQSVERHLAWYQQKPGQAPRLLIYEAATRATGIPARFSGSGSGTEFTLTISSLQSEDFAVYYCQQYQQWPLTFGGGTKVEIK

SEQ ID NO: 940 - protein, 120 aa, Artificial Sequence; identical to SEQ ID NO: 936
  source: /note="Description of Artificial Sequence: Synthetic polypeptide"

SEQ ID NO: 941 - DNA, 321 bp, Artificial Sequence; identical to SEQ ID NO: 737
  source: /note="Description of Artificial Sequence: Synthetic polynucleotide"

SEQ ID NO: 942 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcgtacggtaaatactatgcagacgccgtgaagggccgattcaccatctccagagacaactccaagaacacgctgtatctgcaaatgaacagcctgagagccgaggacacggctgtgtattactgtgcgagagataagacgatttttggagtggtccccgactactggggccagggaaccctggtcaccgtgtctagt

SEQ ID NO: 943 - protein, 107 aa, Artificial Sequence; identical to SEQ ID NO: 739
  source: /note="Description of Artificial Sequence: Synthetic polypeptide"

SEQ ID NO: 944 - protein, 120 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDAYGKYYADAVKGRFTISRDNSKNTLYLQMNSLRAEDTAVYYCARDKTIFGVVPDYWGQGTLVTVSS

SEQ ID NO: 945 - DNA, 321 bp, Artificial Sequence; identical to SEQ ID NO: 753
  source: /note="Description of Artificial Sequence: Synthetic polynucleotide"

SEQ ID NO: 946 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttccagaactatggcatgcactgggtccgccaggctccaggcgaggggctggagtgggtggcagctatatggtttgatgcgtacgacaaatactatgcagacgccgtgaagggccgattcaccatctccagagacaactccaagaacacgctgtatctgcaaatgaacagcctgagagccgaggacacggctgtgtattactgtgcgagagataagtcgatttttggagtggtccccgactactggggccagggaaccctggtcaccgtgtctagt

SEQ ID NO: 947 - protein, 107 aa, Artificial Sequence; identical to SEQ ID NO: 755
  source: /note="Description of Artificial Sequence: Synthetic polypeptide"

SEQ ID NO: 948 - protein, 120 aa, Artificial Sequence
  source: /note="Description of Artificial Sequence: Synthetic polypeptide"
QVQLVESGGGVVQPGRSLRLSCAASGFTFQNYGMHWVRQAPGEGLEWVAAIWFDAYDKYYADAVKGRFTISRDNSKNTLYLQMNSLRAEDTAVYYCARDKSIFGVVPDYWGQGTLVTVSS

SEQ ID NO: 949 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaacagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataacaactggcctctcactttcggcggagggaccaaggtggagatcaaa

SEQ ID NO: 950 - DNA, 360 bp, Artificial Sequence; identical to SEQ ID NO: 946
  source: /note="Description of Artificial Sequence: Synthetic polynucleotide"

SEQ ID NO: 951 - protein, 107 aa, Artificial Sequence
  source: /note="Description of Artificial Sequence: Synthetic polypeptide"
EIVMTQSPATLSVSPGERATLSCRASQSVNRHLAWYQQKPGQAPRLLIYEAATRATGIPARFSGSGSGTEFTLTISSLQSEDFAVYYCQQYNNWPLTFGGGTKVEIK

SEQ ID NO: 952 - protein, 120 aa, Artificial Sequence; identical to SEQ ID NO: 948
  source: /note="Description of Artificial Sequence: Synthetic polypeptide"

SEQ ID NO: 953 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaccagccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaa

SEQ ID NO: 954 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttccagaactatggcatgcactgggtccgccaggctccaggcgaggggctggagtgggtggcagctatatggtttgatgcgtacgacaaatactatgcagacgccgtgaagggccgattcaccatctccagagacaactccaagaacacgctgtatctgcaaatgaacagcctgagagccgaggacacggctgtgtattactgtgcgagagatctcgcgatttttggagtggtccccgactactggggccagggaaccctggtcaccgtgtctagt

SEQ ID NO: 955 - protein, 107 aa, Artificial Sequence
  source: /note="Description of Artificial Sequence: Synthetic polypeptide"
EIVMTQSPATLSVSPGERATLSCRASQSVTSHLAWYQQKPGQAPRLLIYEAATRATGIPARFSGSGSGTEFTLTISSLQSEDFAVYYCQQYNQWPLTFGGGTKVEIK

SEQ ID NO: 956 - protein, 120 aa, Artificial Sequence
  source: /note="Description of Artificial Sequence: Synthetic polypeptide"
QVQLVESGGGVVQPGRSLRLSCAASGFTFQNYGMHWVRQAPGEGLEWVAAIWFDAYDKYYADAVKGRFTISRDNSKNTLYLQMNSLRAEDTAVYYCARDLAIFGVVPDYWGQGTLVTVSS

SEQ ID NO: 957 - DNA, 321 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatcagcacttagcctggtaccagcagaaacctggccaggctcccaggctcctcatctaccaggcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaa

SEQ ID NO: 958 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttccagaactatggcatgcactgggtccgccaggctccaggcgaggggctggagtgggtggcagctatatggtttgatgcggctttcaaatactatgcagacgccgtgaagggccgattcaccatctccagagacaactccaagaacacgctgtatctgcaaatgaacagcctgagagccgaggacacggctgtgtattactgtgcgagagatctcgcgatttttggagtggtccccgactactggggccagggaaccctggtcaccgtgtctagt

SEQ ID NO: 959 - protein, 107 aa, Artificial Sequence
  source: /note="Description of Artificial Sequence: Synthetic polypeptide"
EIVMTQSPATLSVSPGERATLSCRASQSVDQHLAWYQQKPGQAPRLLIYQAATRATGIPARFSGSGSGTEFTLTISSLQSEDFAVYYCQQYQNWPLTFGGGTKVEIK

SEQ ID NO: 960 - protein, 120 aa, Artificial Sequence
  source: /note="Description of Artificial Sequence: Synthetic polypeptide"
QVQLVESGGGVVQPGRSLRLSCAASGFTFQNYGMHWVRQAPGEGLEWVAAIWFDAAFKYYADAVKGRFTISRDNSKNTLYLQMNSLRAEDTAVYYCARDLAIFGVVPDYWGQGTLVTVSS

SEQ ID NO: 961 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 962 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatttggcgatttttggagtggtccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 963 - protein, 214 aa, Artificial Sequence
  source: /note="Description of Artificial Sequence: Synthetic polypeptide"
EIVMTQSPATLSVSPGERATLSCRASQSVDRHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 964 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 965 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaacagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 966 - DNA, 1350 bp, Artificial Sequence; identical to SEQ ID NO: 962
  source: /note="Description of Artificial Sequence: Synthetic polynucleotide"

SEQ ID NO: 967 - protein, 214 aa, Artificial Sequence
  source: /note="Description of Artificial Sequence: Synthetic polypeptide"
EIVMTQSPATLSVSPGERATLSCRASQSVNRHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 968 - protein, 450 aa, Artificial Sequence; identical to SEQ ID NO: 964
  source: /note="Description of Artificial Sequence: Synthetic polypeptide"

SEQ ID NO: 969 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttcatagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 970 - DNA, 1350 bp, Artificial Sequence; identical to SEQ ID NO: 962
  source: /note="Description of Artificial Sequence: Synthetic polynucleotide"

SEQ ID NO: 971 - protein, 214 aa, Artificial Sequence
  source: /note="Description of Artificial Sequence: Synthetic polypeptide"
EIVMTQSPATLSVSPGERATLSCRASQSVHRHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 972 - protein, 450 aa, Artificial Sequence; identical to SEQ ID NO: 964
  source: /note="Description of Artificial Sequence: Synthetic polypeptide"

SEQ ID NO: 973 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgaaagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 974 - DNA, 1350 bp, Artificial Sequence; identical to SEQ ID NO: 962
  source: /note="Description of Artificial Sequence: Synthetic polynucleotide"

SEQ ID NO: 975 - protein, 214 aa, Artificial Sequence
  source: /note="Description of Artificial Sequence: Synthetic polypeptide"
EIVMTQSPATLSVSPGERATLSCRASQSVERHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 976 - protein, 450 aa, Artificial Sequence; identical to SEQ ID NO: 964
  source: /note="Description of Artificial Sequence: Synthetic polypeptide"

SEQ ID NO: 977 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 978 - DNA, 1350 bp, Artificial Sequence; identical to SEQ ID NO: 962
  source: /note="Description of Artificial Sequence: Synthetic polynucleotide"

SEQ ID NO: 979 - protein, 214 aa, Artificial Sequence
  source: /note="Description of Artificial Sequence: Synthetic polypeptide"
EIVMTQSPATLSVSPGERATLSCRASQSVFRHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 980 - protein, 450 aa, Artificial Sequence; identical to SEQ ID NO: 964
  source: /note="Description of Artificial Sequence: Synthetic polypeptide"

SEQ ID NO: 981 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaacagacacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 982 - DNA, 1350 bp, Artificial Sequence; identical to SEQ ID NO: 962
  source: /note="Description of Artificial Sequence: Synthetic polynucleotide"

SEQ ID NO: 983 - protein, 214 aa, Artificial Sequence
  source: /note="Description of Artificial Sequence: Synthetic polypeptide"
EIVMTQSPATLSVSPGERATLSCRASQSVNRHLAWYQQKPGQAPRLLIYEAATRATGIPARVSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 984 - protein, 450 aa, Artificial Sequence; identical to SEQ ID NO: 964
  source: /note="Description of Artificial Sequence: Synthetic polypeptide"

SEQ ID NO: 985 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgaaagacacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 986 - DNA, 1350 bp, Artificial Sequence; identical to SEQ ID NO: 962
  source: /note="Description of Artificial Sequence: Synthetic polynucleotide"

SEQ ID NO: 987 - protein, 214 aa, Artificial Sequence
  source: /note="Description of Artificial Sequence: Synthetic polypeptide"
EIVMTQSPATLSVSPGERATLSCRASQSVERHLAWYQQKPGQAPRLLIYEAATRATGIPARVSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 988 - protein, 450 aa, Artificial Sequence; identical to SEQ ID NO: 964
  source: /note="Description of Artificial Sequence: Synthetic polypeptide"

SEQ ID NO: 989 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatagacacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 990 - DNA, 1350 bp, Artificial Sequence; identical to SEQ ID NO: 962
  source: /note="Description of Artificial Sequence: Synthetic polynucleotide"

SEQ ID NO: 991 - protein, 214 aa, Artificial Sequence
  source: /note="Description of Artificial Sequence: Synthetic polypeptide"
EIVMTQSPATLSVSPGERATLSCRASQSVDRHLAWYQQKPGQAPRLLIYEAATRATGIPARVSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 992 - protein, 450 aa, Artificial Sequence; identical to SEQ ID NO: 964
  source: /note="Description of Artificial Sequence: Synthetic polypeptide"

SEQ ID NO: 993 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttctgagtcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataacaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 994 - DNA, 1350 bp, Artificial Sequence; identical to SEQ ID NO: 962
  source: /note="Description of Artificial Sequence: Synthetic polynucleotide"

SEQ ID NO: 995 - protein, 214 aa, Artificial Sequence
  source: /note="Description of Artificial Sequence: Synthetic polypeptide"
EIVMTQSPATLSVSPGERATLSCRASQSVLSHLAWYQQKPGQAPRLLIYEAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 996 - protein, 450 aa, Artificial Sequence; identical to SEQ ID NO: 964
  source: /note="Description of Artificial Sequence: Synthetic polypeptide"

SEQ ID NO: 997 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttctgagtcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 998 - DNA, 1350 bp, Artificial Sequence; identical to SEQ ID NO: 962
  source: /note="Description of Artificial Sequence: Synthetic polynucleotide"

SEQ ID NO: 999 - protein, 214 aa, Artificial Sequence
  source: /note="Description of Artificial Sequence: Synthetic polypeptide"
EIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1000 - protein, 450 aa, Artificial Sequence; identical to SEQ ID NO: 964
  source: /note="Description of Artificial Sequence: Synthetic polypeptide"

SEQ ID NO: 1001 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttatgagtcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1002 - DNA, 1350 bp, Artificial Sequence; identical to SEQ ID NO: 962
  source: /note="Description of Artificial Sequence: Synthetic polynucleotide"

SEQ ID NO: 1003 - protein, 214 aa, Artificial Sequence
  source: /note="Description of Artificial Sequence: Synthetic polypeptide"
EIVMTQSPATLSVSPGERATLSCRASQSVMSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1004 - protein, 450 aa, Artificial Sequence; identical to SEQ ID NO: 964
  source: /note="Description of Artificial Sequence: Synthetic polypeptide"

SEQ ID NO: 1005 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttctgacgcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1006 - DNA, 1350 bp, Artificial Sequence; identical to SEQ ID NO: 962
  source: /note="Description of Artificial Sequence: Synthetic polynucleotide"

SEQ ID NO: 1007 - protein, 214 aa, Artificial Sequence
  source: /note="Description of Artificial Sequence: Synthetic polypeptide"
EIVMTQSPATLSVSPGERATLSCRASQSVLTHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1008 - protein, 450 aa, Artificial Sequence; identical to SEQ ID NO: 964
  source: /note="Description of Artificial Sequence: Synthetic polypeptide"

SEQ ID NO: 1009 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatctgcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1010 - DNA, 1350 bp, Artificial Sequence; identical to SEQ ID NO: 962
  source: /note="Description of Artificial Sequence: Synthetic polynucleotide"

SEQ ID NO: 1011 - protein, 214 aa, Artificial Sequence
  source: /note="Description of Artificial Sequence: Synthetic polypeptide"
EIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1012 - protein, 450 aa, Artificial Sequence; identical to SEQ ID NO: 964
  source: /note="Description of Artificial Sequence: Synthetic polypeptide"

SEQ ID NO: 1013 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcgaacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1014 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatctggcgatttttggagtgattcccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1015 - protein, 214 aa, Artificial Sequence
  source: /note="Description of Artificial Sequence: Synthetic polypeptide"
EIVMTQSPATLSVSPGERATLSCRASQSVSEHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1016 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVIPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1017 - DNA, 642 bp, Artificial Sequence; identical to SEQ ID NO: 1013
  source: /note="Description of Artificial Sequence: Synthetic polynucleotide"

SEQ ID NO: 1018 - DNA, 1350 bp, Artificial Sequence; identical to SEQ ID NO: 962
  source: /note="Description of Artificial Sequence: Synthetic polynucleotide"

SEQ ID NO: 1019 - protein, 214 aa, Artificial Sequence; identical to SEQ ID NO: 1015
  source: /note="Description of Artificial Sequence: Synthetic polypeptide"

SEQ ID NO: 1020 - protein, 450 aa, Artificial Sequence; identical to SEQ ID NO: 964
  source: /note="Description of Artificial Sequence: Synthetic polypeptide"

SEQ ID NO: 1021 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagccggcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagcactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1022 - DNA, 1350 bp, Artificial Sequence; identical to SEQ ID NO: 962
  source: /note="Description of Artificial Sequence: Synthetic polynucleotide"

SEQ ID NO: 1023 - protein, 214 aa, Artificial Sequence
  source: /note="Description of Artificial Sequence: Synthetic polypeptide"
EIVMTQSPATLSVSPGERATLSCRASQSVSRHLAWYQQKPGQAPRLLIYEAATRATGIPARFSGSGSGTEFTLTISSLQSEDFAVYYCQQYQHWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1024 - protein, 450 aa, Artificial Sequence; identical to SEQ ID NO: 964
  source: /note="Description of Artificial Sequence: Synthetic polypeptide"

SEQ ID NO: 1025 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcagccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1026 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttccagaactatggcatgcactgggtccgccaggctccaggcgaggggctggagtgggtggcagctatatggtttgatgcgtctgacaaatactatgcagacgccgtgaagggccgattcaccatctccagagacaactccaagaacacgctgtatctgcaaatgaacagcctgagagccgaggacacggctgtgtattactgtgcgagagatcttgcgatttttggagtggtccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1027 - protein, 214 aa, Artificial Sequence
  source: /note="Description of Artificial Sequence: Synthetic polypeptide"
EIVMTQSPATLSVSPGERATLSCRASQSVFSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1028 - protein, 450 aa, Artificial Sequence
  source: /note="Description of Artificial Sequence: Synthetic polypeptide"
QVQLVESGGGVVQPGRSLRLSCAASGFTFQNYGMHWVRQAPGEGLEWVAAIWFDASDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1029 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcagccacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1030 - DNA, 1350 bp, Artificial Sequence; identical to SEQ ID NO: 1026
  source: /note="Description of Artificial Sequence: Synthetic polynucleotide"

SEQ ID NO: 1031 - protein, 214 aa, Artificial Sequence
  source: /note="Description of Artificial Sequence: Synthetic polypeptide"
EIVMTQSPATLSVSPGERATLSCRASQSVFSHLAWYQQKPGQAPRLLIYEAATRATGIPARVSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1032 - protein, 450 aa, Artificial Sequence; identical to SEQ ID NO: 1028
  source: /note="Description of Artificial Sequence: Synthetic polypeptide"

SEQ ID NO: 1033 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttctgagtcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagcagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1034 - DNA, 1350 bp, Artificial Sequence; identical to SEQ ID NO: 1026
  source: /note="Description of Artificial Sequence: Synthetic polynucleotide"

SEQ ID NO: 1035 - protein, 214 aa, Artificial Sequence
  source: /note="Description of Artificial Sequence: Synthetic polypeptide"
EIVMTQSPATLSVSPGERATLSCRASQSVLSHLAWYQQKPGQAPRLLIYEAATRATGIPARFSGSGSGTEFTLTISSLQSEDFAVYYCQQYQQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1036 - protein, 450 aa, Artificial Sequence; identical to SEQ ID NO: 1028
  source: /note="Description of Artificial Sequence: Synthetic polypeptide"

SEQ ID NO: 1037 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcagccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagcagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1038 - DNA, 1350 bp, Artificial Sequence; identical to SEQ ID NO: 962
  source: /note="Description of Artificial Sequence: Synthetic polynucleotide"

SEQ ID NO: 1039 - protein, 214 aa, Artificial Sequence
  source: /note="Description of Artificial Sequence: Synthetic polypeptide"
EIVMTQSPATLSVSPGERATLSCRASQSVFSHLAWYQQKPGQAPRLLIYEAATRATGIPARFSGSGSGTEFTLTISSLQSEDFAVYYCQQYQQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1040 - protein, 450 aa, Artificial Sequence; identical to SEQ ID NO: 964
  source: /note="Description of Artificial Sequence: Synthetic polypeptide"

SEQ ID NO: 1041 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcagccacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtatcagcagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1042 - DNA, 1350 bp, Artificial Sequence; identical to SEQ ID NO: 962
  source: /note="Description of Artificial Sequence: Synthetic polynucleotide"

SEQ ID NO: 1043 - protein, 214 aa, Artificial Sequence
  source: /note="Description of Artificial Sequence: Synthetic polypeptide"
EIVMTQSPATLSVSPGERATLSCRASQSVFSHLAWYQQKPGQAPRLLIYEAATRATGIPARVSGSGSGTEFTLTISSLQSEDFAVYYCQQYQQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1044 - protein, 450 aa, Artificial Sequence; identical to SEQ ID NO: 964
  source: /note="Description of Artificial Sequence: Synthetic polypeptide"

SEQ ID NO: 1045 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttcagagccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1046 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatattgcgatttttggagtggtccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1047 - protein, 214 aa, Artificial Sequence
  source: /note="Description of Artificial Sequence: Synthetic polypeptide"
EIVMTQSPATLSVSPGERATLSCRASQSVQSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1048 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDIAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1049 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagtagccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagcagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1050 - DNA, 1350 bp, Artificial Sequence; identical to SEQ ID NO: 1046
  source: /note="Description of Artificial Sequence: Synthetic polynucleotide"

SEQ ID NO: 1051 - protein, 214 aa, Artificial Sequence
  source: /note="Description of Artificial Sequence: Synthetic polypeptide"
EIVMTQSPATLSVSPGERATLSCRASQSVSSHLAWYQQKPGQAPRLLIYEAATRATGIPARFSGSGSGTEFTLTISSLQSEDFAVYYCQQYQQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1052 - protein, 450 aa, Artificial Sequence; identical to SEQ ID NO: 1048
  source: /note="Description of Artificial Sequence: Synthetic polypeptide"

SEQ ID NO: 1053 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcacgcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataacaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1054 - DNA, 1350 bp, Artificial Sequence; identical to SEQ ID NO: 962
  source: /note="Description of Artificial Sequence: Synthetic polynucleotide"

SEQ ID NO: 1055 - protein, 214 aa, Artificial Sequence
  source: /note="Description of Artificial Sequence: Synthetic polypeptide"
EIVMTQSPATLSVSPGERATLSCRASQSVFTHLAWYQQKPGQAPRLLIYEAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1056 - protein, 450 aa, Artificial Sequence; identical to SEQ ID NO: 964
  source: /note="Description of Artificial Sequence: Synthetic polypeptide"

SEQ ID NO: 1057 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcacgcacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtataacaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1058 - DNA, 1350 bp, Artificial Sequence; identical to SEQ ID NO: 962
  source: /note="Description of Artificial Sequence: Synthetic polynucleotide"

SEQ ID NO: 1059 - protein, 214 aa, Artificial Sequence
  source: /note="Description of Artificial Sequence: Synthetic polypeptide"
EIVMTQSPATLSVSPGERATLSCRASQSVFTHLAWYQQKPGQAPRLLIYEAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1060 - protein, 450 aa, Artificial Sequence; identical to SEQ ID NO: 964
  source: /note="Description of Artificial Sequence: Synthetic polypeptide"

SEQ ID NO: 1061 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgtttttgaacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataacaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1062 - DNA, 1350 bp, Artificial Sequence; identical to SEQ ID NO: 962
  source: /note="Description of Artificial Sequence: Synthetic polynucleotide"

SEQ ID NO: 1063 - protein, 214 aa, Artificial Sequence
  source: /note="Description of Artificial Sequence: Synthetic polypeptide"
EIVMTQSPATLSVSPGERATLSCRASQSVFEHLAWYQQKPGQAPRLLIYEAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1064 - protein, 450 aa, Artificial Sequence; identical to SEQ ID NO: 964
  source: /note="Description of Artificial Sequence: Synthetic polypeptide"

SEQ ID NO: 1065 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgaacagcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataacaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1066 - DNA, 1350 bp, Artificial Sequence; identical to SEQ ID NO: 962
  source: /note="Description of Artificial Sequence: Synthetic polynucleotide"

SEQ ID NO: 1067 - protein, 214 aa, Artificial Sequence
  source: /note="Description of Artificial Sequence: Synthetic polypeptide"
EIVMTQSPATLSVSPGERATLSCRASQSVEQHLAWYQQKPGQAPRLLIYEAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1068 - protein, 450 aa, Artificial Sequence; identical to SEQ ID NO: 964
  source: /note="Description of Artificial Sequence: Synthetic polypeptide"

SEQ ID NO: 1069 - DNA, 642 bp, Artificial Sequence
  source: /note="Description of Artificial Sequence: Synthetic polynucleotide"
gaaatagtgatgacgcagtctccggccaccctgtctgtgtctccaggggaaagagccaccctctcctgcagggccagtcagagtgttcatagccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1070 - DNA, 1350 bp, Artificial Sequence; identical to SEQ ID NO: 962
  source: /note="Description of Artificial Sequence: Synthetic polynucleotide"

SEQ ID NO: 1071 - protein, 214 aa, Artificial Sequence
  source: /note="Description of Artificial Sequence: Synthetic polypeptide"
EIVMTQSPATLSVSPGERATLSCRASQSVHSHLAWYQQKPGQAPRLLIYEAATRATGIPARFSGSGSGTEFTLTISSLQSEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1072 - protein, 450 aa, Artificial Sequence; identical to SEQ ID NO: 964
  source: /note="Description of Artificial Sequence: Synthetic polypeptide"

SEQ ID NO: 1073 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttcatcatcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1074 - DNA, 1350 bp, Artificial Sequence; identical to SEQ ID NO: 962
  source: /note="Description of Artificial Sequence: Synthetic polynucleotide"

SEQ ID NO: 1075 - protein, 214 aa, Artificial Sequence
  source: /note="Description of Artificial Sequence: Synthetic polypeptide"
EIVMTQSPATLSVSPGERATLSCRASQSVHHHLAWYQQKPGQAPRLLIYEAATRATGIPARFSGSGSGTEFTLTISSLQSEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1076 - protein, 450 aa, Artificial Sequence; identical to SEQ ID NO: 964
  source: /note="Description of Artificial Sequence: Synthetic polypeptide"

SEQ ID NO: 1077 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttcatagccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataacaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1078 - DNA, 1350 bp, Artificial Sequence; identical to SEQ ID NO: 962
  source: /note="Description of Artificial Sequence: Synthetic polynucleotide"

SEQ ID NO: 1079 - protein, 214 aa, Artificial Sequence
  source: /note="Description of Artificial Sequence: Synthetic polypeptide"
EIVMTQSPATLSVSPGERATLSCRASQSVHSHLAWYQQKPGQAPRLLIYEAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1080 - protein, 450 aa, Artificial Sequence; identical to SEQ ID NO: 964
  source: /note="Description of Artificial Sequence: Synthetic polypeptide"

SEQ ID NO: 1081 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatgtcaacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1082 - DNA, 1350 bp, Artificial Sequence; identical to SEQ ID NO: 962
  source: /note="Description of Artificial Sequence: Synthetic polynucleotide"

SEQ ID NO: 1083 - protein, 214 aa, Artificial Sequence
  source: /note="Description of Artificial Sequence: Synthetic polypeptide"
EIVMTQSPATLSVSPGERATLSCRASQSVDVNLAWYQQKPGQAPRLLIYEAATRATGIPARFSGSGSGTEFTLTISSLQSEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1084 - protein, 450 aa, Artificial Sequence; identical to SEQ ID NO: 964
  source: /note="Description of Artificial Sequence: Synthetic polypeptide"

SEQ ID NO: 1085 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatgtccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1086 - DNA, 1350 bp, Artificial Sequence; identical to SEQ ID NO: 962
  source: /note="Description of Artificial Sequence: Synthetic polynucleotide"

SEQ ID NO: 1087 - protein, 214 aa, Artificial Sequence
  source: /note="Description of Artificial Sequence: Synthetic polypeptide"
EIVMTQSPATLSVSPGERATLSCRASQSVDVHLAWYQQKPGQAPRLLIYEAATRATGIPARFSGSGSGTEFTLTISSLQSEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1088 - protein, 450 aa, Artificial Sequence; identical to SEQ ID NO: 964
  source: /note="Description of Artificial Sequence: Synthetic polypeptide"

SEQ ID NO: 1089 - DNA, 642 bp, Artificial Sequence; identical to SEQ ID NO: 1061
  source: /note="Description of Artificial Sequence: Synthetic polynucleotide"

SEQ ID NO: 1090 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatattgcgatttttggagtgtttcccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1091 - protein, 214 aa, Artificial Sequence; identical to SEQ ID NO: 1063
  source: /note="Description of Artificial Sequence: Synthetic polypeptide"

SEQ ID NO: 1092 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDIAIFGVFPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1093 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgtttttgaacacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtataacaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1094 - DNA, 1350 bp, Artificial Sequence; identical to SEQ ID NO: 1090
  source: /note="Description of Artificial Sequence: Synthetic polynucleotide"

SEQ ID NO: 1095 - protein, 214 aa, Artificial Sequence
  source: /note="Description of Artificial Sequence: Synthetic polypeptide"
EIVMTQSPATLSVSPGERATLSCRASQSVFEHLAWYQQKPGQAPRLLIYEAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1096 - protein, 450 aa, Artificial Sequence; identical to SEQ ID NO: 1092
  source: /note="Description of Artificial Sequence: Synthetic polypeptide"

SEQ ID NO: 1097 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttcgaacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1098 - DNA, 1350 bp, Artificial Sequence; identical to SEQ ID NO: 1046
  source: /note="Description of Artificial Sequence: Synthetic polynucleotide"

SEQ ID NO: 1099 - protein, 214 aa, Artificial Sequence
  source: /note="Description of Artificial Sequence: Synthetic polypeptide"
EIVMTQSPATLSVSPGERATLSCRASQSVFEHLAWYQQKPGQAPRLLIYEAATRATGIPARFSGSGSGTEFTLTISSLQSEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1100 - protein, 450 aa, Artificial Sequence; identical to SEQ ID NO: 1048
  source: /note="Description of Artificial Sequence: Synthetic polypeptide"

SEQ ID NO: 1101 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttctggaacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataacaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1102 - DNA, 1350 bp, Artificial Sequence; identical to SEQ ID NO: 1046
  source: /note="Description of Artificial Sequence: Synthetic polynucleotide"

SEQ ID NO: 1103 - protein, 214 aa, Artificial Sequence
  source: /note="Description of Artificial Sequence: Synthetic polypeptide"
EIVMTQSPATLSVSPGERATLSCRASQSVLEHLAWYQQKPGQAPRLLIYEAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1104 - protein, 450 aa, Artificial Sequence; identical to SEQ ID NO: 1048
  source: /note="Description of Artificial Sequence: Synthetic polypeptide"

SEQ ID NO: 1105 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1106 - DNA, 1350 bp, Artificial Sequence; identical to SEQ ID NO: 1090
  source: /note="Description of Artificial Sequence: Synthetic polynucleotide"

SEQ ID NO: 1107 - protein, 214 aa, Artificial Sequence
  source: /note="Description of Artificial Sequence: Synthetic polypeptide"
EIVMTQSPATLSVSPGERATLSCRASQSVDRHLAWYQQKPGQAPRLLIYEAATRATGIPARFSGSGSGTEFTLTISSLQSEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1108 - protein, 450 aa, Artificial Sequence; identical to SEQ ID NO: 1092
  source: /note="Description of Artificial Sequence: Synthetic polypeptide"

SEQ ID NO: 1109 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaaccggcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagcagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1110 - DNA, 1350 bp, Artificial Sequence; identical to SEQ ID NO: 1090
  source: /note="Description of Artificial Sequence: Synthetic polynucleotide"

SEQ ID NO: 1111 - protein, 214 aa, Artificial Sequence
  source: /note="Description of Artificial Sequence: Synthetic polypeptide"
EIVMTQSPATLSVSPGERATLSCRASQSVNRHLAWYQQKPGQAPRLLIYEAATRATGIPARFSGSGSGTEFTLTISSLQSEDFAVYYCQQYQQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1112 - protein, 450 aa, Artificial Sequence; identical to SEQ ID NO: 1092
  source: /note="Description of Artificial Sequence: Synthetic polypeptide"

SEQ ID NO: 1113 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaacgtacacttagcctggtaccagcagaaacctggccaggctcccaggctcctcatctaccaggcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1114 - DNA, 1350 bp, Artificial Sequence; identical to SEQ ID NO: 1090
  source: /note="Description of Artificial Sequence: Synthetic polynucleotide"

SEQ ID NO: 1115 - protein, 214 aa, Artificial Sequence
  source: /note="Description of Artificial Sequence: Synthetic polypeptide"
EIVMTQSPATLSVSPGERATLSCRASQSVNVHLAWYQQKPGQAPRLLIYQAATRATGIPARFSGSGSGTEFTLTISSLQSEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1116 - protein, 450 aa, Artificial Sequence; identical to SEQ ID NO: 1092
  source: /note="Description of Artificial Sequence: Synthetic polypeptide"

SEQ ID NO: 1117 - DNA, 642 bp, Artificial Sequence; identical to SEQ ID NO: 1005
  source: /note="Description of Artificial Sequence: Synthetic polynucleotide"

SEQ ID NO: 1118 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatattgcgatttttggagtgatccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1119 - protein, 214 aa, Artificial Sequence; identical to SEQ ID NO: 1007
  source: /note="Description of Artificial Sequence: Synthetic polypeptide"

SEQ ID NO: 1120 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDIAIFGVIPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1121 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttctgacgcacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1122 - DNA, 1350 bp, Artificial Sequence; identical to SEQ ID NO: 1118
  source: /note="Description of Artificial Sequence: Synthetic polynucleotide"

SEQ ID NO: 1123 - protein, 214 aa, Artificial Sequence
  source: /note="Description of Artificial Sequence: Synthetic polypeptide"
EIVMTQSPATLSVSPGERATLSCRASQSVLTHLAWYQQKPGQAPRLLIYEAATRATGIPARVSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1124 - protein, 450 aa, Artificial Sequence; identical to SEQ ID NO: 1120
  source: /note="Description of Artificial Sequence: Synthetic polypeptide"

SEQ ID NO: 1125 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctgcagtctgaagattttgcagtttattactgtcagcagtataataactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1126 - DNA, 1350 bp, Artificial Sequence; identical to SEQ ID NO: 962
  source: /note="Description of Artificial Sequence: Synthetic polynucleotide"

SEQ ID NO: 1127 - protein, 214 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1128 - protein, 450 aa, Artificial Sequence; identical to SEQ ID NO: 964
  source: /note="Description of Artificial Sequence: Synthetic polypeptide"

SEQ ID NO: 1129 - DNA, 642 bp, Artificial Sequence; identical to SEQ ID NO: 1125
  source: /note="Description of Artificial Sequence: Synthetic polynucleotide"

SEQ ID NO: 1130 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgattactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1131 - protein, 214 aa, Artificial Sequence; identical to SEQ ID NO: 1127
  source: /note="Description of Artificial Sequence: Synthetic polypeptide"

SEQ ID NO: 1132 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1133 - DNA, 642 bp, Artificial Sequence; identical to SEQ ID NO: 1125
  source: /note="Description of Artificial Sequence: Synthetic polynucleotide"

SEQ ID NO: 1134 - DNA, 1350 bp, Artificial Sequence; identical to SEQ ID NO: 1046
  source: /note="Description of Artificial Sequence: Synthetic polynucleotide"

SEQ ID NO: 1135 - protein, 214 aa, Artificial Sequence; identical to SEQ ID NO: 1127
  source: /note="Description of Artificial Sequence: Synthetic polypeptide"

SEQ ID NO: 1136 - protein, 450 aa, Artificial Sequence; identical to SEQ ID NO: 1048
  source: /note="Description of Artificial Sequence: Synthetic polypeptide"

SEQ ID NO: 1137 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccagggtcagtggcagtgggtctgggacagagttcactctcaccatcagcagcctgcagtctgaagattttgcagtttattactgtcagcagtataataactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1138 - DNA, 1350 bp, Artificial Sequence; identical to SEQ ID NO: 962
  source: /note="Description of Artificial Sequence: Synthetic polynucleotide"

SEQ ID NO: 1139 - protein, 214 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1140 - protein, 450 aa, Artificial Sequence; identical to SEQ ID NO: 964
  source: /note="Description of Artificial Sequence: Synthetic polypeptide"

SEQ ID NO: 1141 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatgaagcagccaccagggccactggtatcccagccagggtcagtggcagtgggtctgggacagagttcactctcaccatcagcagcctgcagtctgaagattttgcagtttattactgtcagcagtataataactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1142 - DNA, 1350 bp, Artificial Sequence; identical to SEQ ID NO: 1130
  source: /note="Description of Artificial Sequence: Synthetic polynucleotide"

SEQ ID NO: 1143 - protein, 214 aa, Artificial Sequence
  source: /note="Description of Artificial Sequence: Synthetic polypeptide"
EIVMTQSPATLSVSPGERATLSCRASQSVSSNLAWYQQKPGQAPRLLIYEAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1144 - protein, 450 aa, Artificial Sequence; identical to SEQ ID NO: 1132
  source: /note="Description of Artificial Sequence: Synthetic polypeptide"

SEQ ID NO: 1145 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatgttaacttagcctggtaccagcagaaacctggccaggctcccaggctcctcatctacaacgcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1146 - DNA, 1350 bp, Artificial Sequence; identical to SEQ ID NO: 962
  source: /note="Description of Artificial Sequence: Synthetic polynucleotide"

SEQ ID NO: 1147 - protein, 214 aa, Artificial Sequence
  source: /note="Description of Artificial Sequence: Synthetic polypeptide"
EIVMTQSPATLSVSPGERATLSCRASQSVDVNLAWYQQKPGQAPRLLIYNAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1148 - protein, 450 aa, Artificial Sequence; identical to SEQ ID NO: 964
  source: /note="Description of Artificial Sequence: Synthetic polypeptide"

SEQ ID NO: 1149 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatgttaacttagcctggtaccagcagaaacctggccaggctcccaggctcctcatctacaacgcagccaccagggccactggtatcccagccagggtcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1150 - DNA, 1350 bp, Artificial Sequence; identical to SEQ ID NO: 962
  source: /note="Description of Artificial Sequence: Synthetic polynucleotide"

SEQ ID NO: 1151 - protein, 214 aa, Artificial Sequence
  source: /note="Description of Artificial Sequence: Synthetic polypeptide"
EIVMTQSPATLSVSPGERATLSCRASQSVDVNLAWYQQKPGQAPRLLIYNAATRATGIPARVSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1152 - protein, 450 aa, Artificial Sequence; identical to SEQ ID NO: 964
  source: /note="Description of Artificial Sequence: Synthetic polypeptide"

SEQ ID NO: 1153 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttcatacgaacttagcctggtaccagcagaaacctggccaggctcccaggctcctcatctacaacgcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1154 - DNA, 1350 bp, Artificial Sequence; identical to SEQ ID NO: 1046
  source: /note="Description of Artificial Sequence: Synthetic polynucleotide"

SEQ ID NO: 1155 - protein, 214 aa, Artificial Sequence
  source: /note="Description of Artificial Sequence: Synthetic polypeptide"
EIVMTQSPATLSVSPGERATLSCRASQSVHTNLAWYQQKPGQAPRLLIYNAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1156 - protein, 450 aa, Artificial Sequence; identical to SEQ ID NO: 1048
  source: /note="Description of Artificial Sequence: Synthetic polypeptide"

SEQ ID NO: 1157 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaacctgaacttagcctggtaccagcagaaacctggccaggctcccaggctcctcatctaccaggcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1158 - DNA, 1350 bp, Artificial Sequence; identical to SEQ ID NO: 962
  source: /note="Description of Artificial Sequence: Synthetic polynucleotide"

SEQ ID NO: 1159 - protein, 214 aa, Artificial Sequence
  source: /note="Description of Artificial Sequence: Synthetic polypeptide"
EIVMTQSPATLSVSPGERATLSCRASQSVNLNLAWYQQKPGQAPRLLIYQAATRATGIPARFSGSGSGTEFTLTISSLQSEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1160 - protein, 450 aa, Artificial Sequence; identical to SEQ ID NO: 964
  source: /note="Description of Artificial Sequence: Synthetic polypeptide"

SEQ ID NO: 1161 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttttccagaacttagcctggtaccagcagaaacctggccaggctcccaggctcctcatctaccaggcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1162 - DNA, 1350 bp, Artificial Sequence; identical to SEQ ID NO: 1046
  source: /note="Description of Artificial Sequence: Synthetic polynucleotide"

SEQ ID NO: 1163 - protein, 214 aa, Artificial Sequence
  source: /note="Description of Artificial Sequence: Synthetic polypeptide"
EIVMTQSPATLSVSPGERATLSCRASQSVFQNLAWYQQKPGQAPRLLIYQAATRATGIPARFSGSGSGTEFTLTISSLQSEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1164 - protein, 450 aa, Artificial Sequence; identical to SEQ ID NO: 1048
  source: /note="Description of Artificial Sequence: Synthetic polypeptide"

SEQ ID NO: 1165 - DNA, 642 bp, Artificial Sequence; identical to SEQ ID NO: 1105
  source: /note="Description of Artificial Sequence: Synthetic polynucleotide"

SEQ ID NO: 1166 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttccagaactatggcatgcactgggtccgccaggctccaggcgaggggctggagtgggtggcagctatatggtttgatgcgtacggtaaatactatgcagacgccgtgaagggccgattcaccatctccagagacaactccaagaacacgctgtatctgcaaatgaacagcctgagagccgaggacacggctgtgtattactgtgcgagagatcagacgatttttggagtggtccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1167 - protein, 214 aa, Artificial Sequence; identical to SEQ ID NO: 1107
  source: /note="Description of Artificial Sequence: Synthetic polypeptide"

SEQ ID NO: 1168 - protein, 450 aa, Artificial Sequence
  source: /note="Description of Artificial Sequence: Synthetic polypeptide"
QVQLVESGGGVVQPGRSLRLSCAASGFTFQNYGMHWVRQAPGEGLEWVAAIWFDAYGKYYADAVKGRFTISRDNSKNTLYLQMNSLRAEDTAVYYCARDQTIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1169 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatagacacttagcctggtaccagcagaaacctggccaggctcccaggctcctcatctacgaagcagccaccagggccactggtatcccagccagggtcagtggcagtgggtctgggacagagttcactctcaccatcagcagcctgcagtctgaagattttgcagtttattactgtcagcagtataaccagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1170 - DNA, 1350 bp, Artificial Sequence; identical to SEQ ID NO: 1166
  source: /note="Description of Artificial Sequence: Synthetic polynucleotide"

SEQ ID NO: 1171 - protein, 214 aa, Artificial Sequence
  source: /note="Description of Artificial Sequence: Synthetic polypeptide"
EIVMTQSPATLSVSPGERATLSCRASQSVDRHLAWYQQKPGQAPRLLIYEAATRATGIPARVSGSGSGTEFTLTISSLQSEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1172 - protein, 450 aa, Artificial Sequence; identical to SEQ ID NO: 1168
  source: /note="Description of Artificial Sequence: Synthetic polypeptide"

SEQ ID NO: 1173 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaaccggcacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1174 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttccagaactatggcatgcactgggtccgccaggctccaggcgaggggctggagtgggtggcagctatatggtttgatgcgtacggtaaatactatgcagacgccgtgaagggccgattcaccatctccagagacaactccaagaacacgctgtatctgcaaatgaacagcctgagagccgaggacacggctgtgtattactgtgcgagagataagacgatttttggagtggtccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1175 - protein, 214 aa, Artificial Sequence
  source: /note="Description of Artificial Sequence: Synthetic polypeptide"
EIVMTQSPATLSVSPGERATLSCRASQSVNRHLAWYQQKPGQAPRLLIYEAATRATGIPARFSGSGSGTEFTLTISSLQSEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1176 - protein, 450 aa, Artificial Sequence
  source: /note="Description of Artificial Sequence: Synthetic polypeptide"
QVQLVESGGGVVQPGRSLRLSCAASGFTFQNYGMHWVRQAPGEGLEWVAAIWFDAYGKYYADAVKGRFTISRDNSKNTLYLQMNSLRAEDTAVYYCARDKTIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1177 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgaaagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagcagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1178 - DNA, 1350 bp, Artificial Sequence; identical to SEQ ID NO: 1174
  source: /note="Description of Artificial Sequence: Synthetic polynucleotide"

SEQ ID NO: 1179 - protein, 214 aa, Artificial Sequence
  source: /note="Description of Artificial Sequence: Synthetic polypeptide"
EIVMTQSPATLSVSPGERATLSCRASQSVERHLAWYQQKPGQAPRLLIYEAATRATGIPARFSGSGSGTEFTLTISSLQSEDFAVYYCQQYQQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1180 - protein, 450 aa, Artificial Sequence; identical to SEQ ID NO: 1176
  source: /note="Description of Artificial Sequence: Synthetic polypeptide"

SEQ ID NO: 1181 - DNA, 642 bp, Artificial Sequence; identical to SEQ ID NO: 977
  source: /note="Description of Artificial Sequence: Synthetic polynucleotide"

SEQ ID NO: 1182 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcgtacggtaaatactatgcagacgccgtgaagggccgattcaccatctccagagacaactccaagaacacgctgtatctgcaaatgaacagcctgagagccgaggacacggctgtgtattactgtgcgagagataagacgatttttggagtggtccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1183 - protein, 214 aa, Artificial Sequence; identical to SEQ ID NO: 979
  source: /note="Description of Artificial Sequence: Synthetic polypeptide"

SEQ ID NO: 1184 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDAYGKYYADAVKGRFTISRDNSKNTLYLQMNSLRAEDTAVYYCARDKTIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1185 - DNA, 642 bp, Artificial Sequence; identical to SEQ ID NO: 993
  source: /note="Description of Artificial Sequence: Synthetic polynucleotide"

SEQ ID NO: 1186 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttccagaactatggcatgcactgggtccgccaggctccaggcgaggggctggagtgggtggcagctatatggtttgatgcgtacgacaaatactatgcagacgccgtgaagggccgattcaccatctccagagacaactccaagaacacgctgtatctgcaaatgaacagcctgagagccgaggacacggctgtgtattactgtgcgagagataagtcgatttttggagtggtccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1187 - protein, 214 aa, Artificial Sequence; identical to SEQ ID NO: 995
  source: /note="Description of Artificial Sequence: Synthetic polypeptide"

SEQ ID NO: 1188 - protein, 450 aa, Artificial Sequence
  source: /note="Description of Artificial Sequence: Synthetic polypeptide"
QVQLVESGGGVVQPGRSLRLSCAASGFTFQNYGMHWVRQAPGEGLEWVAAIWFDAYDKYYADAVKGRFTISRDNSKNTLYLQMNSLRAEDTAVYYCARDKSIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1189 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaacagacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataacaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1190 - DNA, 1350 bp, Artificial Sequence; identical to SEQ ID NO: 1186
  source: /note="Description of Artificial Sequence: Synthetic polynucleotide"

SEQ ID NO: 1191 - protein, 214 aa, Artificial Sequence
  source: /note="Description of Artificial Sequence: Synthetic polypeptide"
EIVMTQSPATLSVSPGERATLSCRASQSVNRHLAWYQQKPGQAPRLLIYEAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1192 - protein, 450 aa, Artificial Sequence; identical to SEQ ID NO: 1188
  source: /note="Description of Artificial Sequence: Synthetic polypeptide"

SEQ ID NO: 1193 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttaccagccacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtataaccagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1194 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttccagaactatggcatgcactgggtccgccaggctccaggcgaggggctggagtgggtggcagctatatggtttgatgcgtacgacaaatactatgcagacgccgtgaagggccgattcaccatctccagagacaactccaagaacacgctgtatctgcaaatgaacagcctgagagccgaggacacggctgtgtattactgtgcgagagatctcgcgatttttggagtggtccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1195 - protein, 214 aa, Artificial Sequence
  source: /note="Description of Artificial Sequence: Synthetic polypeptide"
EIVMTQSPATLSVSPGERATLSCRASQSVTSHLAWYQQKPGQAPRLLIYEAATRATGIPARFSGSGSGTEFTLTISSLQSEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1196 - protein, 450 aa, Artificial Sequence
  source: /note="Description of Artificial Sequence: Synthetic polypeptide"
QVQLVESGGGVVQPGRSLRLSCAASGFTFQNYGMHWVRQAPGEGLEWVAAIWFDAYDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1197 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttgatcagcacttagcctggtaccagcagaaacctggccaggctcccaggctcctcatctaccaggcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1198 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttccagaactatggcatgcactgggtccgccaggctccaggcgaggggctggagtgggtggcagctatatggtttgatgcggctttcaaatactatgcagacgccgtgaagggccgattcaccatctccagagacaactccaagaacacgctgtatctgcaaatgaacagcctgagagccgaggacacggctgtgtattactgtgcgagagatctcgcgatttttggagtggtccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1199 - protein, 214 aa, Artificial Sequence
  source: /note="Description of Artificial Sequence: Synthetic polypeptide"
EIVMTQSPATLSVSPGERATLSCRASQSVDQHLAWYQQKPGQAPRLLIYQAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1200 - protein, 450 aa, Artificial Sequence
  source: /note="Description of Artificial Sequence: Synthetic polypeptide"
QVQLVESGGGVVQPGRSLRLSCAASGFTFQNYGMHWVRQAPGEGLEWVAAIWFDAAFKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1201 - protein, 466 aa, Homo sapiens
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 1202 - DNA, 2024 bp, Homo sapiens
ggcagcggtggcaggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaagggggcctagggtggtctgggaggcgtctccaaggaggtgacacttaagccatccccgaaagaggtgaaagagatcactttggggagagctggagaacaggattctaggcggaagcgatagcataggcaaaggcccttgggcaggaaggcgctcagccttggctggagtagaattaagtcagagccaacaggtggggagagacagagaagtgggcaggggcacccaagttgggatttcatttcaggtgcattggagattcttaggagtgtctcttgggggtaatattttattttttaaaaaatgaggat

SEQ ID NO: 1203 - protein, 430 aa, Homo sapiens
MTTSPILQLLLRLSLCGLLLQRAETGSKGQTAGELYQRWERYRRECQETLAAAEPPSVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 1204 - DNA, 1290 bp, Homo sapiens
atgaccaccagcccgattctgcagctgctgctgcgcctgagcctgtgcggcctgctgctgcagcgcgcggaaaccggcagcaaaggccagaccgcgggcgaactgtatcagcgctgggaacgctatcgccgcgaatgccaggaaaccctggcggcggcggaaccgccgagcgtggcggcgggctttgtgctgcgccagtgcggcagcgatggccagtggggcctgtggcgcgatcatacccagtgcgaaaacccggaaaaaaacgaagcgtttctggatcagcgcctgattctggaacgcctgcaggtgatgtataccgtgggctatagcctgagcctggcgaccctgctgctggcgctgctgattctgagcctgtttcgccgcctgcattgcacccgcaactatattcatattaacctgtttaccagctttatgctgcgcgcggcggcgattctgagccgcgatcgcctgctgccgcgcccgggcccgtatctgggcgatcaggcgctggcgctgtggaaccaggcgctggcggcgtgccgcaccgcgcagattgtgacccagtattgcgtgggcgcgaactatacctggctgctggtggaaggcgtgtatctgcatagcctgctggtgctggtgggcggcagcgaagaaggccattttcgctattatctgctgctgggctggggcgcgccggcgctgtttgtgattccgtgggtgattgtgcgctatctgtatgaaaacacccagtgctgggaacgcaacgaagtgaaagcgatttggtggattattcgcaccccgattctgatgaccattctgattaactttctgatttttattcgcattctgggcattctgctgagcaaactgcgcacccgccagatgcgctgccgcgattatcgcctgcgcctggcgcgcagcaccctgaccctggtgccgctgctgggcgtgcatgaagtggtgtttgcgccggtgaccgaagaacaggcgcgcggcgcgctgcgctttgcgaaactgggctttgaaatttttctgagcagctttcagggctttctggtgagcgtgctgtattgctttattaacaaagaagtgcagagcgaaattcgccgcggctggcatcattgccgcctgcgccgcagcctgggcgaagaacagcgccagctgccggaacgcgcgtttcgcgcgctgccgagcggcagcggcccgggcgaagtgccgaccagccgcggcctgagcagcggcaccctgccgggcccgggcaacgaagcgagccgcgaactggaaagctattgc

SEQ ID NO: 1205 - protein, 493 aa, Artificial Sequence
  source: /note="Description of Artificial Sequence: Synthetic polypeptide"
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVGRDPAAAPALWRRRGTAPPLSAIVSQVQSEIRRGWHHCRLRRSLGEEQRQLPERAFRALPSGSGPGEVPTSRGLSSGTLPGPGNEASRELESYC

SEQ ID NO: 1206 - DNA, 1482 bp, Artificial Sequence
  source: /note="Description of Artificial Sequence: Synthetic polynucleotide"
atgaccaccagcccgattctgcagctgctgctgcgcctgagcctgtgcggcctgctgctgcagcgcgcggaaaccggcagcaaaggccagaccgcgggcgaactgtatcagcgctgggaacgctatcgccgcgaatgccaggaaaccctggcggcggcggaaccgccgagcggcctggcgtgcaacggcagctttgatatgtatgtgtgctgggattatgcggcgccgaacgcgaccgcgcgcgcgagctgcccgtggtatctgccgtggcatcatcatgtggcggcgggctttgtgctgcgccagtgcggcagcgatggccagtggggcctgtggcgcgatcatacccagtgcgaaaacccggaaaaaaacgaagcgtttctggatcagcgcctgattctggaacgcctgcaggtgatgtataccgtgggctatagcctgagcctggcgaccctgctgctggcgctgctgattctgagcctgtttcgccgcctgcattgcacccgcaactatattcatattaacctgtttaccagctttatgctgcgcgcggcggcgattctgagccgcgatcgcctgctgccgcgcccgggcccgtatctgggcgatcaggcgctggcgctgtggaaccaggcgctggcggcgtgccgcaccgcgcagattgtgacccagtattgcgtgggcgcgaactatacctggctgctggtggaaggcgtgtatctgcatagcctgctggtgctggtgggcggcagcgaagaaggccattttcgctattatctgctgctgggctggggcgcgccggcgctgtttgtgattccgtgggtgattgtgcgctatctgtatgaaaacacccagtgctgggaacgcaacgaagtgaaagcgatttggtggattattcgcaccccgattctgatgaccattctgattaactttctgatttttattcgcattctgggcattctgctgagcaaactgcgcacccgccagatgcgctgccgcgattatcgcctgcgcctggcgcgcagcaccctgaccctggtgccgctgctgggcgtgcatgaagtggtgtttgcgccggtgaccgaagaacaggcgcgcggcgcgctgcgctttgcgaaactgggctttgaaatttttctgagcagctttcagggctttctggtgagcgtgctgtattgctttattaacaaagaagtgggccgcgatccggcggcggcgccggcgctgtggcgccgccgcggcaccgcgccgccgctgagcgcgattgtgagccaggtgcagagcgaaattcgccgcggctggcatcattgccgcctgcgccgcagcctgggcgaagaacagcgccagctgccggaacgcgcgtttcgcgcgctgccgagcggcagcggcccgggcgaagtgccgaccagccgcggcctgagcagcggcaccctgccgggcccgggcaacgaagcgagccgcgaactggaaagctattgctaa

SEQ ID NO: 1207 - protein, 460 aa, Mus musculus
MPLRLLLLLLWLWGLQWAETDSEGQTTTGELYQRWEHYGQECQKMLETTEPPSGLACNGSFDMYACWNYTAANTTARVSCPWYLPWFRQVSAGFVFRQCGSDGQWGSWRDHTQCENPEKNGAFQDQTLILERLQIMYTVGYSLSLTTLLLALLILSLFRRLHCTRNYIHMNLFTSFMLRAAAILTRDQLLPPLGPYTGDQAPTPWNQALAACRTAQIMTQYCVGANYTWLLVEGVYLHHLLVIVGRSEKGHFRCYLLLGWGAPALFVIPWVIVRYLRENTQCWERNEVKAIWWIIRTPILITILINFLIFIRILGILVSKLRTRQMRCPDYRLRLARSTLTLVPLLGVHEVVFAPVTEEQVEGSLRFAKLAFEIFLSSFQGFLVSVLYCFINKEVQSEIRQGWRHRRLRLSLQEQRPRPHQELAPRAVPLSSACREAAVGNALPSGMLHVPGDEVLESYC

SEQ ID NO: 1208 - DNA, 1383 bp, Mus musculus
atgccgctgcgcctgctgctgctgctgctgtggctgtggggcctgcagtgggcggaaaccgatagcgaaggccagaccaccaccggcgaactgtatcagcgctgggaacattatggccaggaatgccagaaaatgctggaaaccaccgaaccgccgagcggcctggcgtgcaacggcagctttgatatgtatgcgtgctggaactataccgcggcgaacaccaccgcgcgcgtgagctgcccgtggtatctgccgtggtttcgccaggtgagcgcgggctttgtgtttcgccagtgcggcagcgatggccagtggggcagctggcgcgatcatacccagtgcgaaaacccggaaaaaaacggcgcgtttcaggatcagaccctgattctggaacgcctgcagattatgtataccgtgggctatagcctgagcctgaccaccctgctgctggcgctgctgattctgagcctgtttcgccgcctgcattgcacccgcaactatattcatatgaacctgtttaccagctttatgctgcgcgcggcggcgattctgacccgcgatcagctgctgccgccgctgggcccgtataccggcgatcaggcgccgaccccgtggaaccaggcgctggcggcgtgccgcaccgcgcagattatgacccagtattgcgtgggcgcgaactatacctggctgctggtggaaggcgtgtatctgcatcatctgctggtgattgtgggccgcagcgaaaaaggccattttcgctgctatctgctgctgggctggggcgcgccggcgctgtttgtgattccgtgggtgattgtgcgctatctgcgcgaaaacacccagtgctgggaacgcaacgaagtgaaagcgatttggtggattattcgcaccccgattctgattaccattctgattaactttctgatttttattcgcattctgggcattctggtgagcaaactgcgcacccgccagatgcgctgcccggattatcgcctgcgcctggcgcgcagcaccctgaccctggtgccgctgctgggcgtgcatgaagtggtgtttgcgccggtgaccgaagaacaggtggaaggcagcctgcgctttgcgaaactggcgtttgaaatttttctgagcagctttcagggctttctggtgagcgtgctgtattgctttattaacaaagaagtgcagagcgaaattcgccagggctggcgccatcgccgcctgcgcctgagcctgcaggaacagcgcccgcgcccgcatcaggaactggcgccgcgcgcggtgccgctgagcagcgcgtgccgcgaagcggcggtgggcaacgcgctgccgagcggcatgctgcatgtgccgggcgatgaagtgctggaaagctattgctaa

SEQ ID NO: 1209 - protein, 230 aa, Artificial Sequence
  source: /note="Description of Artificial Sequence: Synthetic polypeptide"
MPLRLLLLLLWLWGLQWAETDSEGQTTTGELYQRWEHYGQECQKMLETTEPPSGLACNGSFDMYACWNYTAANTTARVSCPWYLPWFRQVSAGFVFRQCGSDGQWGSWRDHTQCENPEKNGAFQDQTLILERLQIMYTVGYSLSLTTLLLALLILSLFRRLHCTRNYIHMNLFTSFMLRAAAILTRDQLLPPLGPYTGDQAPTPWNQVLHRLLPGGTKTFPIYFRTFPHH

SEQ ID NO: 1210 - DNA, 693 bp, Artificial Sequence
  source: /note="Description of Artificial Sequence: Synthetic polynucleotide"
atgccgctgcgcctgctgctgctgctgctgtggctgtggggcctgcagtgggcggaaaccgatagcgaaggccagaccaccaccggcgaactgtatcagcgctgggaacattatggccaggaatgccagaaaatgctggaaaccaccgaaccgccgagcggcctggcgtgcaacggcagctttgatatgtatgcgtgctggaactataccgcggcgaacaccaccgcgcgcgtgagctgcccgtggtatctgccgtggtttcgccaggtgagcgcgggctttgtgtttcgccagtgcggcagcgatggccagtggggcagctggcgcgatcatacccagtgcgaaaacccggaaaaaaacggcgcgtttcaggatcagaccctgattctggaacgcctgcagattatgtataccgtgggctatagcctgagcctgaccaccctgctgctggcgctgctgattctgagcctgtttcgccgcctgcattgcacccgcaactatattcatatgaacctgtttaccagctttatgctgcgcgcggcggcgattctgacccgcgatcagctgctgccgccgctgggcccgtataccggcgatcaggcgccgaccccgtggaaccaggtgctgcatcgcctgctgccgggcggcaccaaaacctttccgatttattttcgcacctttccgcatcattaa

SEQ ID NO: 1211 - protein, 42 aa, Homo sapiens
YAEGTFISDYSIAMDKIHQQDFVNWLLAQKGKKNDWKHNITQ

SEQ ID NO: 1212 - DNA, 126 bp, Homo sapiens
tatgcggaaggcacctttattagcgattatagcattgcgatggataaaattcatcagcaggattttgtgaactggctgctggcgcagaaaggcaaaaaaaacgattggaaacataacattacccag

SEQ ID NO: 1213 - protein, 42 aa, Mus musculus
YAEGTFISDYSIAMDKIRQQDFVNWLLAQRGKKSDWKHNITQ

SEQ ID NO: 1214 - DNA, 126 bp, Mus musculus
tatgcggaaggcacctttattagcgattatagcattgcgatggataaaattcgccagcaggattttgtgaactggctgctggcgcagcgcggcaaaaaaagcgattggaaacataacattacccag

SEQ ID NO: 1215 - protein, 42 aa, Rattus sp.
YAEGTFISDYSIAMDKIRQQDFVNWLLAQKGKKNDWKHNLTQ

SEQ ID NO: 1216 - DNA, 126 bp, Rattus sp.
tatgcggaaggcacctttattagcgattatagcattgcgatggataaaattcgccagcaggattttgtgaactggctgctggcgcagaaaggcaaaaaaaacgattggaaacataacctgacccag

SEQ ID NO: 1217 - protein, 22 aa, Artificial Sequence
  source: /note="Description of Artificial Sequence: Synthetic peptide"
MDMRVPAQLLGLLLLWLRGARC

SEQ ID NO: 1218 - DNA, 66 bp, Artificial Sequence
  source: /note="Description of Artificial Sequence: Synthetic oligonucleotide"
atggacatgagagtgcctgcacagctgctgggcctgctgctgctgtggctgagaggcgccagatgc

SEQ ID NO: 1219 - protein, 19 aa, Artificial Sequence
  source: /note="Description of Artificial Sequence: Synthetic peptide"
MAWALLLLTLLTQGTGSWA

SEQ ID NO: 1220 - DNA, 57 bp, Artificial Sequence
  source: /note="Description of Artificial Sequence: Synthetic oligonucleotide"
atggcctgggctctgctgctcctcaccctcctcactcagggcacagggtcctgggcc

SEQ ID NO: 1221-1222 - skipped (2 entries)

SEQ ID NO: 1223 - protein, 39 aa, Heloderma suspectum
HGEGTFTSDLSKQMEEEAVRLFIEWLKNGGPSSGAPPPS

SEQ ID NO: 1224 - protein, 39 aa, Heloderma horridum
HSDGTFTSDLSKQMEEEAVRLFIEWLKNGGPSSGAPPPS

SEQ ID NO: 1225 - protein, 39 aa, Artificial Sequence
  source: /note="Description of Artificial Sequence: Synthetic polypeptide"
HGEGTFTSDLSKQLEEEAVRLFIEWLKNGGPSSGAPPPS

SEQ ID NO: 1226 - protein, 39 aa, Artificial Sequence
  source: /note="Description of Artificial Sequence: Synthetic polypeptide"
HGEGTFTSDLSKQLEEEAVRLFIEFLKNGGPSSGAPPPS

SEQ ID NO: 1227 - protein, 39 aa, Artificial Sequence
  source: /note="Description of Artificial Sequence: Synthetic polypeptide"
HGEGTFTSDLSKQLEEEAARLFIEFLKNGGPSSGAPPPS

SEQ ID NO: 1228 - protein, 30 aa, Heloderma suspectum
HGEGTFTSDLSKQMEEEAVRLFIEWLKNGG

SEQ ID NO: 1229 - protein, 30 aa, Artificial Sequence
  source: /note="Description of Artificial Sequence: Synthetic polypeptide"
HGEGTFTSDLSKQLEEEAVRLFIEWLKNGG

SEQ ID NO: 1230 - protein, 30 aa, Artificial Sequence
  source: /note="Description of Artificial Sequence: Synthetic polypeptide"
HGEGTFTSDLSKQLEEEAVRLFIEFLKNGG

SEQ ID NO: 1231 - protein, 30 aa, Artificial Sequence
  source: /note="Description of Artificial Sequence: Synthetic polypeptide"
HGEGTFTSDLSKQLEEEAARLFIEFLKNGG

SEQ ID NO: 1232 - protein, 28 aa, Heloderma suspectum
HGEGTFTSDLSKQMEEEAVRLFIEWLKN

SEQ ID NO: 1233 - protein, 28 aa, Artificial Sequence
  source: /note="Description of Artificial Sequence: Synthetic peptide"
HGEGTFTSDLSKQLEEEAVRLFIEWLKN

SEQ ID NO: 1234 - protein, 28 aa, Artificial Sequence
  source: /note="Description of Artificial Sequence: Synthetic peptide"
HGEGTFTSDLSKQLEEEAVRLFIEFLKN

SEQ ID NO: 1235 - protein, 28 aa, Artificial Sequence
  source: /note="Description of Artificial Sequence: Synthetic peptide"
HGEGTFTSDLSKQLEEEAARLFIEFLKN

SEQ ID NO: 1236 - protein, 39 aa, Artificial Sequence
  source: /note="Description of Artificial Sequence: Synthetic polypeptide"
HGEGTFTSDLSKQLEEKAAKEFIEFLKQGGPSSGAPPPS

SEQ ID NO: 1237 - protein, 39 aa, Artificial Sequence
  source: /note="Description of Artificial Sequence: Synthetic polypeptide"
HGEGTFTSDLSKQLEEKAAKEFIEWLKQGGPSSGAPPPS

SEQ ID NO: 1238 - protein, 39 aa, Artificial Sequence
  source: /note="Description of Artificial Sequence: Synthetic polypeptide"
  MOD_RES (14)..(14): OctylGly
HGEGTFTSDLSKQGEEEAVRLFIEWLKQGGPSSGAPPPS

SEQ ID NO: 1239 - protein, 39 aa, Artificial Sequence
  source: /note="Description of Artificial Sequence: Synthetic polypeptide"
  MOD_RES (34)..(34): OctylGly
HGEGTFTSDLSKQLEEEAVRLFIEWLKQGGPSSGAPPPS

SEQ ID NO: 1240 - protein, 37 aa, Artificial Sequence
  source: /note="Description of Artificial Sequence: Synthetic polypeptide"
HGEFTFTSDLSKQLEEEAVRLFIEWLKQGGPSKEIIS

SEQ ID NO: 1241 - protein, 39 aa, Artificial Sequence
  source: /note="Description of Artificial Sequence: Synthetic polypeptide"
HGEFTFTSDLSKQLEEKAAKEFIEWLKQGGPSSGAPPPS

SEQ ID NO: 1242 - protein, 39 aa, Artificial Sequence
  source: /note="Description of Artificial Sequence: Synthetic polypeptide"
HGEGTFTSDLVKILEAEAVRKFIEFLKNGGPSSGAPPPS

SEQ ID NO: 1243 - protein, 40 aa, Artificial Sequence
  source: /note="Description of Artificial Sequence: Synthetic polypeptide"
HGEGTFTSDLSKQMEEEAVRLFIEWLKNGGPSSGAPPPSK

SEQ ID NO: 1244 - protein, 31 aa, Homo sapiens
HAEGTFTSDVSSYLEGQAAKEFIAWLVKGRG

SEQ ID NO: 1245 - protein, 30 aa, Homo sapiens
HAEGTFTSDVSSYLEGQAAKEFIAWLVKGR

SEQ ID NO: 1246 - protein, 30 aa, Artificial Sequence
  source: /note="Description of Artificial Sequence: Synthetic polypeptide"
  MOD_RES (2)..(2): Alpha-amino-isobutyric acid
  MOD_RES (29)..(29): Alpha-amino-isobutyric acid
HXEGTFTSDVSSYLEGQAAREFIAFLVRXR

SEQ ID NO: 1247 - protein, 31 aa, Artificial Sequence; identical to SEQ ID NO: 1244
  source: /note="Description of Artificial Sequence: Synthetic polypeptide"
  VARIANT (2)..(2): /replace="Val" or "Gly"
  VARIANT (16)..(16): /replace="Lys" or "Glu"
  VARIANT (17)..(17): /replace="Lys"
  VARIANT (24)..(24): /replace="Glu"
  VARIANT (27)..(27): /replace="Lys"
  VARIANT (28)..(28): /replace="Asn" or "Arg"
  VARIANT (30)..(30): /replace="Gly"
  VARIANT (31)..(31): /replace="His" or "Pro" or " "
  SITE (1)..(31): /note="Variant residues given in the sequence have no preference with respect to those in the annotations for variant positions"

SEQ ID NO: 1248 - protein, 31 aa, Artificial Sequence
  source: /note="Description of Artificial Sequence: Synthetic polypeptide"
HAEGTFTSDVSSYLEGQAAKEFIAWLVRGRG

SEQ ID NO: 1249 - protein, 31 aa, Artificial Sequence
  source: /note="Description of Artificial Sequence: Synthetic polypeptide"
HAEGTFTSDVSSYLEGQAAKEFIEWLVKGRG

SEQ ID NO: 1250 - protein, 31 aa, Artificial Sequence
  source: /note="Description of Artificial Sequence: Synthetic polypeptide"
HAEGTFTSDVSSYLEKQAAKEFIAWLVKGRG

SEQ ID NO: 1251 - protein, 31 aa, Artificial Sequence
  source: /note="Description of Artificial Sequence: Synthetic polypeptide"
HGEGTFTSDVSSYLEEQAAKEFIAWLVKGGG

SEQ ID NO: 1252 - protein, 31 aa, Artificial Sequence
  source: /note="Description of Artificial Sequence: Synthetic polypeptide"
HVEGTFTSDVSSYLEEQAAKEFIAWLVKGGG

SEQ ID NO: 1253 - protein, 31 aa, Artificial Sequence
  source: /note="Description of Artificial Sequence: Synthetic polypeptide"
HGEGTFTSDVSSYLEEQAAKEFIAWLKNGGG

SEQ ID NO: 1254 - protein, 31 aa, Artificial Sequence
  source: /note="Description of Artificial Sequence: Synthetic polypeptide"
HVEGTFTSDVSSYLEEQAAKEFIAWLKNGGG

SEQ ID NO: 1255 - protein, 31 aa, Artificial Sequence
  source: /note="Description of Artificial Sequence: Synthetic polypeptide"
HGEGTFTSDVSSYLEEQAAKEFIAWLVKGGP

SEQ ID NO: 1256 - protein, 31 aa, Artificial Sequence
  source: /note="Description of Artificial Sequence: Synthetic polypeptide"
HVEGTFTSDVSSYLEEQAAKEFIAWLVKGGP

SEQ ID NO: 1257 - protein, 31 aa, Artificial Sequence
  source: /note="Description of Artificial Sequence: Synthetic polypeptide"
HGEGTFTSDVSSYLEEQAAKEFIAWLKNGGP

SEQ ID NO: 1258 - protein, 31 aa, Artificial Sequence
  source: /note="Description of Artificial Sequence: Synthetic polypeptide"
HVEGTFTSDVSSYLEEQAAKEFIAWLKNGGP

SEQ ID NO: 1259 - protein, 30 aa, Artificial Sequence
  source: /note="Description of Artificial Sequence: Synthetic polypeptide"
HGEGTFTSDVSSYLEEQAAKEFIAWLVKGG

SEQ ID NO: 1260 - protein, 30 aa, Artificial Sequence
  source: /note="Description of Artificial Sequence: Synthetic polypeptide"
HVEGTFTSDVSSYLEEQAAKEFIAWLVKGG

SEQ ID NO: 1261 - protein, 30 aa, Artificial Sequence
  source: /note="Description of Artificial Sequence: Synthetic polypeptide"
HVEGTFTSDVSSYLEEQAAKEFIAWLVNGG

SEQ ID NO: 1262 - protein, 30 aa, Artificial Sequence
  source: /note="Description of Artificial Sequence: Synthetic polypeptide"
HGEGTFTSDVSSYLEEQAAKEFIAWLVNGG

SEQ ID NO: 1263 - protein, 230 aa, Artificial Sequence
  source: /note="Description of Artificial Sequence: Synthetic polypeptide"
  VARIANT (16)..(16): /replace="Glu"
  VARIANT (17)..(17): /replace="Val" or "Ala"
  VARIANT (18)..(18): /replace="Glu" or "Ala"
  VARIANT (80)..(80): /replace="Ala"
  VARIANT (230)..(230): /replace=" "
  SITE (1)..(230): /note="Variant residues given in the sequence have no preference with respect to those in the annotations for variant positions"
AESKYGPPCPPCPAPPFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1264 - protein, 30 aa, Artificial Sequence
  source: /note="Description of Artificial Sequence: Synthetic polypeptide"
  SITE (1)..(30): /note="This sequence may encompass 1-6 'Gly Gly Gly Gly Ser' repeating units"
GGGGSGGGGSGGGGSGGGGSGGGGSGGGGS

SEQ ID NO: 1265 - protein, 275 aa, Artificial Sequence
  source: /note="Description of Artificial Sequence: Synthetic polypeptide"
HGEGTFTSDVSSYLEEQAAKEFIAWLVKGGGGGGGSGGGGSGGGGSAESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 1266 - protein, 40 aa, Artificial Sequence
  source: /note="Description of Artificial Sequence: Synthetic polypeptide"
  MOD_RES (2)..(2): D-Ala
  VARIANT (2)..(2): /replace="Gly" or "Val" or "Leu" or "Ile" or "Ser" or "Thr"
  VARIANT (16)..(16): /replace="Glu" or "Asp" or "Lys"
  VARIANT (27)..(27): /replace="Ile"
  SITE (1)..(40): /note="Variant residues given in the sequence have no preference with respect to those in the annotations for variant positions"
HAEGTFTSDVSSYLEGQAAKEFIAWLVKGGPSSGAPPPCC

SEQ ID NO: 1267 - protein, 40 aa, Artificial Sequence
  source: /note="Description of Artificial Sequence: Synthetic polypeptide"
HVEGTFTSDVSSYLEEQAAKEFIAWLIKGGPSSGAPPPCC

SEQ ID NO: 1268 - protein, 39 aa, Artificial Sequence
  source: /note="Description of Artificial Sequence: Synthetic polypeptide"
HGEGTFTSDLSKQMEEEAVKLFIEWLKNGGPSSGAPPPS

SEQ ID NO: 1269 - protein, 39 aa, Artificial Sequence
  source: /note="Description of Artificial Sequence: Synthetic polypeptide"
HGEGTFTSDLSKQMEEEAVRLFIEWLKNGGPKSGAPPPS

SEQ ID NO: 1270 - protein, 38 aa, Artificial Sequence
  source: /note="Description of Artificial Sequence: Synthetic polypeptide"
GEGTFTSDLSKQMEEEAVKLFIEWLKNGGPSSGAPPPS

SEQ ID NO: 1271 - protein, 39 aa, Artificial Sequence
  source: /note="Description of Artificial Sequence: Synthetic polypeptide"
  MOD_RES (14)..(14): Norleucine
HGEGTFTSDLSRQXEEEAVRLFIEWLRNGGPKSGAPPPS

SEQ ID NO: 1272 - protein, 39 aa, Artificial Sequence; identical to SEQ ID NO: 1268
  source: /note="Description of Artificial Sequence: Synthetic polypeptide"

SEQ ID NO: 1273 - protein, 39 aa, Artificial Sequence; identical to SEQ ID NO: 1268
  source: /note="Description of Artificial Sequence: Synthetic polypeptide"

SEQ ID NO: 1274 - protein, 39 aa, Artificial Sequence; identical to SEQ ID NO: 1268
  source: /note="Description of Artificial Sequence: Synthetic polypeptide"

SEQ ID NO: 1275 - protein, 39 aa, Artificial Sequence; identical to SEQ ID NO: 1268
  source: /note="Description of Artificial Sequence: Synthetic polypeptide"

SEQ ID NO: 1276 - protein, 40 aa, Artificial Sequence; identical to SEQ ID NO: 1243
  source: /note="Description of Artificial Sequence: Synthetic polypeptide"

SEQ ID NO: 1277 - protein, 40 aa, Artificial Sequence; identical to SEQ ID NO: 1243
  source: /note="Description of Artificial Sequence: Synthetic polypeptide"

SEQ ID NO: 1278 - protein, 40 aa, Artificial Sequence; identical to SEQ ID NO: 1243
  source: /note="Description of Artificial Sequence: Synthetic polypeptide"

SEQ ID NO: 1279 - protein, 40 aa, Artificial Sequence; identical to SEQ ID NO: 1243
  source: /note="Description of Artificial Sequence: Synthetic polypeptide"

SEQ ID NO: 1280 - protein, 40 aa, Artificial Sequence; identical to SEQ ID NO: 1243
  source: /note="Description of Artificial Sequence: Synthetic polypeptide"

SEQ ID NO: 1281 - protein, 40 aa, Artificial Sequence; identical to SEQ ID NO: 1243
  source: /note="Description of Artificial Sequence: Synthetic polypeptide"

SEQ ID NO: 1282 - protein, 30 aa, Artificial Sequence
  source: /note="Description of Artificial Sequence: Synthetic polypeptide"
AEGTFTSDVSSYLEGQAAREFIAWLVKGRG

SEQ ID NO: 1283 - protein, 30 aa, Artificial Sequence; identical to SEQ ID NO: 1282
  source: /note="Description of Artificial Sequence: Synthetic polypeptide"

SEQ ID NO: 1284 - protein, 32 aa, Artificial Sequence
  source: /note="Description of Artificial Sequence: Synthetic polypeptide"
HAEGTFTSDVSSYLEGQAAREFIAWLVRGRGK

SEQ ID NO: 1285 - protein, 32 aa, Artificial Sequence; identical to SEQ ID NO: 1284
  source: /note="Description of Artificial Sequence: Synthetic polypeptide"

SEQ ID NO: 1286 - protein, 107 aa, Artificial Sequence; identical to SEQ ID NO: 775
  source: /note="Description of Artificial Sequence: Synthetic polypeptide"

SEQ ID NO: 1287 - protein, 120 aa, Artificial Sequence; identical to SEQ ID NO: 776
  source: /note="Description of Artificial Sequence: Synthetic polypeptide"

SEQ ID NO: 1288 - protein, 214 aa, Artificial Sequence; identical to SEQ ID NO: 1015
  source: /note="Description of Artificial Sequence: Synthetic polypeptide"

SEQ ID NO: 1289 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVIPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1290 - protein, 11 aa, Artificial Sequence
  source: /note="Description of Artificial Sequence: Synthetic peptide"
RASQSVSEHLA

SEQ ID NO: 1291 - protein, 7 aa, Artificial Sequence
  source: /note="Description of Artificial Sequence: Synthetic peptide"
EAATRAT

SEQ ID NO: 1292 - protein, 9 aa, Artificial Sequence
  source: /note="Description of Artificial Sequence: Synthetic peptide"
QQYQNWPLT

SEQ ID NO: 1293 - protein, 5 aa, Artificial Sequence
  source: /note="Description of Artificial Sequence: Synthetic peptide"
NYGMH

SEQ ID NO: 1294 - protein, 17 aa, Artificial Sequence
  source: /note="Description of Artificial Sequence: Synthetic peptide"
AIWFDASDKYYADAVKG

SEQ ID NO: 1295 - protein, 11 aa, Artificial Sequence
  source: /note="Description of Artificial Sequence: Synthetic peptide"
DLAIFGVIPDY

SEQ ID NO: 1296 - protein, 107 aa, Artificial Sequence; identical to SEQ ID NO: 887
  source: /note="Description of Artificial Sequence: Synthetic polypeptide"

SEQ ID NO: 1297 - protein, 120 aa, Artificial Sequence; identical to SEQ ID NO: 808
  source: /note="Description of Artificial Sequence: Synthetic polypeptide"

SEQ ID NO: 1298 - protein, 214 aa, Artificial Sequence; identical to SEQ ID NO: 1127
  source: /note="Description of Artificial Sequence: Synthetic polypeptide"

SEQ ID NO: 1299 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDIAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1300 - protein, 11 aa, Artificial Sequence
  source: /note="Description of Artificial Sequence: Synthetic peptide"
RASQSVSSNLA

SEQ ID NO: 1301 - protein, 7 aa, Artificial Sequence
  source: /note="Description of Artificial Sequence: Synthetic peptide"
GAATRAT

SEQ ID NO: 1302 - protein, 9 aa, Artificial Sequence
  source: /note="Description of Artificial Sequence: Synthetic peptide"
QQYNNWPLT

SEQ ID NO: 1303 - protein, 5 aa, Artificial Sequence
  source: /note="Description of Artificial Sequence: Synthetic peptide"
NYGMH

SEQ ID NO: 1304 - protein, 17 aa, Artificial Sequence
  source: /note="Description of Artificial Sequence: Synthetic peptide"
AIWFDASDKYYADAVKG

SEQ ID NO: 1305 - protein, 11 aa, Artificial Sequence
  source: /note="Description of Artificial Sequence: Synthetic peptide"
DIAIFGVVPDY

SEQ ID NO: 1306 - protein, 107 aa, Artificial Sequence
  source: /note="Description of Artificial Sequence: Synthetic polypeptide"
EIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIK

SEQ ID NO: 1307 - protein, 120 aa, Artificial Sequence; identical to SEQ ID NO: 892
  source: /note="Description of Artificial Sequence: Synthetic polypeptide"

SEQ ID NO: 1308 - protein, 214 aa, Artificial Sequence
  source: /note="Description of Artificial Sequence: Synthetic polypeptide"
EIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1309 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1310 - protein, 11 aa, Artificial Sequence
  source: /note="Description of Artificial Sequence: Synthetic peptide"
RASQSVSSNLA

SEQ ID NO: 1311 - protein, 7 aa, Artificial Sequence
  source: /note="Description of Artificial Sequence: Synthetic peptide"
GAATRAT

SEQ ID NO: 1312 - protein, 9 aa, Artificial Sequence
  source: /note="Description of Artificial Sequence: Synthetic peptide"
QQYNNWPLT

SEQ ID NO: 1313 - protein, 5 aa, Artificial Sequence
  source: /note="Description of Artificial Sequence: Synthetic peptide"
NYGMH

SEQ ID NO: 1314 - protein, 17 aa, Artificial Sequence
  source: /note="Description of Artificial Sequence: Synthetic peptide"
AIWFDASDKYYADAVKG

SEQ ID NO: 1315 - protein, 11 aa, Artificial Sequence
  source: /note="Description of Artificial Sequence: Synthetic peptide"
DQAIFGVVPDY

SEQ ID NO: 1316 - protein, 107 aa, Artificial Sequence
  source: /note="Description of Artificial Sequence: Synthetic polypeptide"
EIVLTQSPATLSLSPGERATLSCRASQSVSEHLAWYQQKPGQAPRLLIYEAATRATGIPDRFSGSGSGTEFTLTISRLEPEDFAVYYCQQYQNWPLTFGGGTKVEIK

SEQ ID NO: 1317 - protein, 120 aa, Artificial Sequence; identical to SEQ ID NO: 776
  source: /note="Description of Artificial Sequence: Synthetic polypeptide"

SEQ ID NO: 1318 - protein, 214 aa, Artificial Sequence
  source: /note="Description of Artificial Sequence: Synthetic polypeptide"
EIVLTQSPATLSLSPGERATLSCRASQSVSEHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1319 - protein, 450 aa, Artificial Sequence; identical to SEQ ID NO: 1289
  source: /note="Description of Artificial Sequence: Synthetic polypeptide"

SEQ ID NO: 1320 - protein, 11 aa, Artificial Sequence
  source: /note="Description of Artificial Sequence: Synthetic peptide"
RASQSVSEHLA

SEQ ID NO: 1321 - protein, 7 aa, Artificial Sequence
  source: /note="Description of Artificial Sequence: Synthetic peptide"
EAATRAT

SEQ ID NO: 1322 - protein, 9 aa, Artificial Sequence
  source: /note="Description of Artificial Sequence: Synthetic peptide"
QQYQNWPLT

SEQ ID NO: 1323 - protein, 5 aa, Artificial Sequence
  source: /note="Description of Artificial Sequence: Synthetic peptide"
NYGMH

SEQ ID NO: 1324 - protein, 17 aa, Artificial Sequence
  source: /note="Description of Artificial Sequence: Synthetic peptide"
AIWFDASDKYYADAVKG

SEQ ID NO: 1325 - protein, 11 aa, Artificial Sequence
  source: /note="Description of Artificial Sequence: Synthetic peptide"
DLAIFGVIPDY

SEQ ID NO: 1326 - protein, 107 aa, Artificial Sequence; identical to SEQ ID NO: 1306
  source: /note="Description of Artificial Sequence: Synthetic polypeptide"

SEQ ID NO: 1327 - protein, 120 aa, Artificial Sequence; identical to SEQ ID NO: 808
  source: /note="Description of Artificial Sequence: Synthetic polypeptide"

SEQ ID NO: 1328 - protein, 214 aa, Artificial Sequence; identical to SEQ ID NO: 1308
  source: /note="Description of Artificial Sequence: Synthetic polypeptide"

SEQ ID NO: 1329 - protein, 450 aa, Artificial Sequence; identical to SEQ ID NO: 1299
  source: /note="Description of Artificial Sequence: Synthetic polypeptide"

SEQ ID NO: 1330 - protein, 11 aa, Artificial Sequence
  source: /note="Description of Artificial Sequence: Synthetic peptide"
RASQSVSSNLA

SEQ ID NO: 1331 - protein, 7 aa, Artificial Sequence
  source: /note="Description of Artificial Sequence: Synthetic peptide"
GAATRAT

SEQ ID NO: 1332 - protein, 9 aa, Artificial Sequence
  source: /note="Description of Artificial Sequence: Synthetic peptide"
QQYNNWPLT

SEQ ID NO: 1333 - protein, 5 aa, Artificial Sequence
  source: /note="Description of Artificial Sequence: Synthetic peptide"
NYGMH

SEQ ID NO: 1334 - protein, 17 aa, Artificial Sequence
  source: /note="Description of Artificial Sequence: Synthetic peptide"
AIWFDASDKYYADAVKG

SEQ ID NO: 1335 - protein, 11 aa, Artificial Sequence
  source: /note="Description of Artificial Sequence: Synthetic peptide"
DIAIFGVVPDY

SEQ ID NO: 1336 - protein, 107 aa, Artificial Sequence
  source: /note="Description of Artificial Sequence: Synthetic polypeptide"
EIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIK

SEQ ID NO: 1337 - protein, 120 aa, Artificial Sequence; identical to SEQ ID NO: 724
  source: /note="Description of Artificial Sequence: Synthetic polypeptide"

SEQ ID NO: 1338 - protein, 214 aa, Artificial Sequence
  source: /note="Description of Artificial Sequence: Synthetic polypeptide"
EIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1339 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1340 - protein, 11 aa, Artificial Sequence
  source: /note="Description of Artificial Sequence: Synthetic peptide"
RASQSVDLHLA

SEQ ID NO: 1341 - protein, 7 aa, Artificial Sequence
  source: /note="Description of Artificial Sequence: Synthetic peptide"
EAATRAT

SEQ ID NO: 1342 - protein, 9 aa, Artificial Sequence
  source: /note="Description of Artificial Sequence: Synthetic peptide"
QQYQNWPLT

SEQ ID NO: 1343 - protein, 5 aa, Artificial Sequence
  source: /note="Description of Artificial Sequence: Synthetic peptide"
NYGMH

SEQ ID NO: 1344 - protein, 17 aa, Artificial Sequence
  source: /note="Description of Artificial Sequence: Synthetic peptide"
AIWFDASDKYYADAVKG

SEQ ID NO: 1345 - protein, 11 aa, Artificial Sequence
  source: /note="Description of Artificial Sequence: Synthetic peptide"
DLAIFGVVPDY

SEQ ID NO: 1346 - protein, 107 aa, Artificial Sequence
  source: /note="Description of Artificial Sequence: Synthetic polypeptide"
EIVLTQSPATLSLSPGERATLSCRASQSVNLNLAWYQQKPGQAPRLLIYQAATRATGIPDRFSGSGSGTEFTLTISRLEPEDFAVYYCQQYNQWPLTFGGGTKVEIK

SEQ ID NO: 1347 - protein, 120 aa, Artificial Sequence; identical to SEQ ID NO: 724
  source: /note="Description of Artificial Sequence: Synthetic polypeptide"

SEQ ID NO: 1348 - protein, 214 aa, Artificial Sequence
  source: /note="Description of Artificial Sequence: Synthetic polypeptide"
EIVLTQSPATLSLSPGERATLSCRASQSVNLNLAWYQQKPGQAPRLLIYQAATRATGIPDRFSGSGSGTEFTLTISRLEPEDFAVYYCQQYNQWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1349 - protein, 450 aa, Artificial Sequence; identical to SEQ ID NO: 1339
  source: /note="Description of Artificial Sequence: Synthetic polypeptide"

SEQ ID NO: 1350 - protein, 11 aa, Artificial Sequence
  source: /note="Description of Artificial Sequence: Synthetic peptide"
RASQSVNLNLA

SEQ ID NO: 1351 - protein, 7 aa, Artificial Sequence
  source: /note="Description of Artificial Sequence: Synthetic peptide"
QAATRAT

SEQ ID NO: 1352 - protein, 9 aa, Artificial Sequence
  source: /note="Description of Artificial Sequence: Synthetic peptide"
QQYNQWPLT

SEQ ID NO: 1353 - protein, 5 aa, Artificial Sequence
  source: /note="Description of Artificial Sequence: Synthetic peptide"
NYGMH

SEQ ID NO: 1354 - protein, 17 aa, Artificial Sequence
  source: /note="Description of Artificial Sequence: Synthetic peptide"
AIWFDASDKYYADAVKG

SEQ ID NO: 1355 - protein, 11 aa, Artificial Sequence
  source: /note="Description of Artificial Sequence: Synthetic peptide"
DLAIFGVVPDY

SEQ ID NO: 1356 - protein, 107 aa, Artificial Sequence
  source: /note="Description of Artificial Sequence: Synthetic polypeptide"
EIVLTQSPATLSLSPGERATLSCRASQSVFSHLAWYQQKPGQAPRLLIYEAATRATGIPDRFSGSGSGTEFTLTISRLEPEDFAVYYCQQYQNWPLTFGGGTKVEIK

SEQ ID NO: 1357 - protein, 120 aa, Artificial Sequence; identical to SEQ ID NO: 788
  source: /note="Description of Artificial Sequence: Synthetic polypeptide"

SEQ ID NO: 1358 - protein, 214 aa, Artificial Sequence
  source: /note="Description of Artificial Sequence: Synthetic polypeptide"
EIVLTQSPATLSLSPGERATLSCRASQSVFSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1359 - protein, 450 aa, Artificial Sequence
  source: /note="Description of Artificial Sequence: Synthetic polypeptide"
QVQLVESGGGVVQPGRSLRLSCAASGFTFQNYGMHWVRQAPGEGLEWVAAIWFDASDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1360 - protein, 11 aa, Artificial Sequence
  source: /note="Description of Artificial Sequence: Synthetic peptide"
RASQSVFSHLA

SEQ ID NO: 1361 - protein, 7 aa, Artificial Sequence
  source: /note="Description of Artificial Sequence: Synthetic peptide"
EAATRAT

SEQ ID NO: 1362 - protein, 9 aa, Artificial Sequence
  source: /note="Description of Artificial Sequence: Synthetic peptide"
QQYQNWPLT

SEQ ID NO: 1363 - protein, 5 aa, Artificial Sequence
  source: /note="Description of Artificial Sequence: Synthetic peptide"
NYGMH

SEQ ID NO: 1364 - protein, 17 aa, Artificial Sequence
  source: /note="Description of Artificial Sequence: Synthetic peptide"
AIWFDASDKYYADAVKG

SEQ ID NO: 1365 - protein, 11 aa, Artificial Sequence
  source: /note="Description of Artificial Sequence: Synthetic peptide"
DLAIFGVVPDY

SEQ ID NO: 1366 - DNA, 708 bp, Artificial Sequence
  source: /note="Description of Artificial Sequence: Synthetic polynucleotide"
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttagcgaacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1367 - DNA, 1416 bp, Artificial Sequence
  source: /note="Description of Artificial Sequence: Synthetic polynucleotide"
atggacatgagggtgcccgctcagctcctggggctcctgctgctgtggctgagaggtgcgcgctgtcaggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatctggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatctggcgatttttggagtgattcccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctctacatcacccgggagcctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgatatcgccgtggagtgggagagcaatgggcagccggagaacaactacaagaccacgcctcccgtgctggactccgacggctccttcttcctctatagcaagctcaccgtggacaagagtaggtggcagcaggggaacgtcttctcatgctccgtgatgcatgaggctctgcacaaccactacacgcagaagagcctctccctgtctccgggtaaa

SEQ ID NO: 1368 - DNA, 708 bp, Artificial Sequence
  source: /note="Description of Artificial Sequence: Synthetic polynucleotide"
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctgcagtctgaagattttgcagtttattactgtcagcagtataataactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1369 - DNA, 1416 bp, Artificial Sequence
  source: /note="Description of Artificial Sequence: Synthetic polynucleotide"
atggacatgagggtgcccgctcagctcctggggctcctgctgctgtggctgagaggtgcgcgctgtcaggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatctggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatattgcgatttttggagtggtccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctctacatcacccgggagcctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgatatcgccgtggagtgggagagcaatgggcagccggagaacaactacaagaccacgcctcccgtgctggactccgacggctccttcttcctctatagcaagctcaccgtggacaagagtaggtggcagcaggggaacgtcttctcatgctccgtgatgcatgaggctctgcacaaccactacacgcagaagagcctctccctgtctccgggtaaa

SEQ ID NO: 1370 - DNA, 708 bp, Artificial Sequence
  source: /note="Description of Artificial Sequence: Synthetic polynucleotide"
atggacatgagggtgcccgctcagctcctggggctcctgctgctgtggctgagaggtgcgcgctgtgaaatcgtgctgacgcagtctccagccaccctgtctctgtctccaggggaaagagccaccctctcctgcagggccagtcagagtgttagcagcaacttagcctggtaccagcagaaacctggccaggctcccaggctcctcatctatggtgcagccaccagggccactggtatcccagacaggttcagtggcagtgggtctgggacagagttcactctcaccatcagcaggctggagcctgaagattttgcagtttattactgtcagcagtataataactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1371 - DNA, 1416 bp, Artificial Sequence
  source: /note="Description of Artificial Sequence: Synthetic polynucleotide"
atggacatgagggtgcccgctcagctcctggggctcctgctgctgtggctgagaggtgcgcgctgtcaggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatctggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgattactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctctacatcacccgggagcctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgatatcgccgtggagtgggagagcaatgggcagccggagaacaactacaagaccacgcctcccgtgctggactccgacggctccttcttcctctatagcaagctcaccgtggacaagagtaggtggcagcaggggaacgtcttctcatgctccgtgatgcatgaggctctgcacaaccactacacgcagaagagcctctccctgtctccgggtaaa

SEQ ID NO: 1372 - DNA, 708 bp, Artificial Sequence
  source: /note="Description of Artificial Sequence: Synthetic polynucleotide"
atggacatgagggtgcccgctcagctcctggggctcctgctgctgtggctgagaggtgcgcgctgtgaaatcgtgctgacgcagtctccagccaccctgtctctgtctccaggggaaagagccaccctctcctgcagggccagtcagagtgttagcgaacacttagcctggtaccagcagaaacctggccaggctcccaggctcctcatctacgaagcagccaccagggccactggtatcccagacaggttcagtggcagtgggtctgggacagagttcactctcaccatcagcaggctggagcctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1373 - DNA, 1416 bp, Artificial Sequence; identical to SEQ ID NO: 1367
  source: /note="Description of Artificial Sequence: Synthetic polynucleotide"

SEQ ID NO: 1374 - DNA, 708 bp, Artificial Sequence; identical to SEQ ID NO: 1370
  source: /note="Description of Artificial Sequence: Synthetic polynucleotide"

SEQ ID NO: 1375 - DNA, 1416 bp, Artificial Sequence; identical to SEQ ID NO: 1369
  source: /note="Description of Artificial Sequence: Synthetic polynucleotide"

SEQ ID NO: 1376 - DNA, 708 bp, Artificial Sequence
  source: /note="Description of Artificial Sequence: Synthetic polynucleotide"
atggacatgagggtgcccgctcagctcctggggctcctgctgctgtggctgagaggtgcgcgctgtgaaatcgtgctgacgcagtctccagccaccctgtctctgtctccaggggaaagagccaccctctcctgcagggccagtcagagtgttgatctgcacttagcctggtaccagcagaaacctggccaggctcccaggctcctcatctacgaagcagccaccagggccactggtatcccagacaggttcagtggcagtgggtctgggacagagttcactctcaccatcagcaggctggagcctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1377 - DNA, 1416 bp, Artificial Sequence
  source: /note="Description of Artificial Sequence: Synthetic polynucleotide"
atggacatgagggtgcccgctcagctcctggggctcctgctgctgtggctgagaggtgcgcgctgtcaggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatctggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatttggcgatttttggagtggtccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctctacatcacccgggagcctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgatatcgccgtggagtgggagagcaatgggcagccggagaacaactacaagaccacgcctcccgtgctggactccgacggctccttcttcctctatagcaagctcaccgtggacaagagtaggtggcagcaggggaacgtcttctcatgctccgtgatgcatgaggctctgcacaaccactacacgcagaagagcctctccctgtctccgggtaaa

SEQ ID NO: 1378 - DNA, 708 bp, Artificial Sequence
  source: /note="Description of Artificial Sequence: Synthetic polynucleotide"
atggacatgagggtgcccgctcagctcctggggctcctgctgctgtggctgagaggtgcgcgctgtgaaatcgtgctgacgcagtctccagccaccctgtctctgtctccaggggaaagagccaccctctcctgcagggccagtcagagtgttaacctgaacttagcctggtaccagcagaaacctggccaggctcccaggctcctcatctaccaggcagccaccagggccactggtatcccagacaggttcagtggcagtgggtctgggacagagttcactctcaccatcagcaggctggagcctgaagattttgcagtttattactgtcagcagtataaccagtggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1379 - DNA, 1416 bp, Artificial Sequence; identical to SEQ ID NO: 1377
  source: /note="Description of Artificial Sequence: Synthetic polynucleotide"

SEQ ID NO: 1380 - DNA, 708 bp, Artificial Sequence
  source: /note="Description of Artificial Sequence: Synthetic polynucleotide"
atggacatgagggtgcccgctcagctcctggggctcctgctgctgtggctgagaggtgcgcgctgtgaaatcgtgctgacgcagtctccagccaccctgtctctgtctccaggggaaagagccaccctctcctgcagggccagtcagagtgttttcagccacttagcctggtaccagcagaaacctggccaggctcccaggctcctcatctacgaagcagccaccagggccactggtatcccagacaggttcagtggcagtgggtctgggacagagttcactctcaccatcagcaggctggagcctgaagattttgcagtttattactgtcagcagtatcagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1381 - DNA, 1416 bp, Artificial Sequence
  source: /note="Description of Artificial Sequence: Synthetic polynucleotide"
atggacatgagggtgcccgctcagctcctggggctcctgctgctgtggctgagaggtgcgcgctgtcaggtgcagctggtggagtctgggggaggcgtggtccagcctgggaggtccctgagactctcctgtgcagcatctggattcaccttccagaactatggcatgcactgggtccgccaggctccaggcgaggggctggagtgggtggcagctatctggtttgatgcgtctgacaaatactatgcagacgccgtgaagggccgattcaccatctccagagacaactccaagaacacgctgtatctgcaaatgaacagcctgagagccgaggacacggctgtgtattactgtgcgagagatcttgcgatttttggagtggtccccgactactggggccagggaaccctggtcaccgtgtctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctctacatcacccgggagcctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgatatcgccgtggagtgggagagcaatgggcagccggagaacaactacaagaccacgcctcccgtgctggactccgacggctccttcttcctctatagcaagctcaccgtggacaagagtaggtggcagcaggggaacgtcttctcatgctccgtgatgcatgaggctctgcacaaccactacacgcagaagagcctctccctgtctccgggtaaa

SEQ ID NO: 1382 - DNA, 321 bp, Artificial Sequence
  source: /note="Description of Artificial Sequence: Synthetic polynucleotide"
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttagcgaacacttagcctggtaccagcagaaacctggccaggctcccaggctcctcatctacgaagcagccaccagggccactggtatcccagccaggttcagtggcagtgggtctgggacagagttcactctcaccatcagcagcctgcagtctgaagattttgcagtt

SEQ ID NO: 1383 - DNA, 360 bp, Artificial Sequence
  source: /note="Description of Artificial Sequence: Synthetic polynucleotide"
atggacatgagggtgcccgctcagctcctggggctcctgctgctgtggctgagaggtgcgcgctgtcaggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatctggtttgatgcaagtgataaatactatgcagacgccgtgaagggccgattcaccatctccagagacaactccaagaacacgctgtatctgcaaatgaacagcctgagagccgaggacacggctgtgtattactgtgcgaga

SEQ ID NO: 1384 - DNA, 321 bp, Artificial Sequence
  source: /note="Description of Artificial Sequence: Synthetic polynucleotide"
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctgcagtctgaagattttgcagtt

SEQ ID NO: 1385 - DNA, 360 bp, Artificial Sequence; identical to SEQ ID NO: 1383
  source: /note="Description of Artificial Sequence: Synthetic polynucleotide"

SEQ ID NO: 1386 - DNA, 321 bp, Artificial Sequence
  source: /note="Description of Artificial Sequence: Synthetic polynucleotide"
atggacatgagggtgcccgctcagctcctggggctcctgctgctgtggctgagaggtgcgcgctgtgaaatcgtgctgacgcagtctccagccaccctgtctctgtctccaggggaaagagccaccctctcctgcagggccagtcagagtgttagcagcaacttagcctggtaccagcagaaacctggccaggctcccaggctcctcatctatggtgcagccaccagggccactggtatcccagacaggttcagtggcagtgggtctgggacagagttcactctcaccatcagcaggctggagcctgaagattttgcagtt

SEQ ID NO: 1387 - DNA, 360 bp, Artificial Sequence; identical to SEQ ID NO: 1383
  source: /note="Description of Artificial Sequence: Synthetic polynucleotide"

SEQ ID NO: 1388 - DNA, 321 bp, Artificial Sequence
  source: /note="Description of Artificial Sequence: Synthetic polynucleotide"
atggacatgagggtgcccgctcagctcctggggctcctgctgctgtggctgagaggtgcgcgctgtgaaatcgtgctgacgcagtctccagccaccctgtctctgtctccaggggaaagagccaccctctcctgcagggccagtcagagtgttagcgaacacttagcctggtaccagcagaaacctggccaggctcccaggctcctcatctacgaagcagccaccagggccactggtatcccagacaggttcagtggcagtgggtctgggacagagttcactctcaccatcagcaggctggagcctgaagattttgcagtt

SEQ ID NO: 1389 - DNA, 360 bp, Artificial Sequence; identical to SEQ ID NO: 1383
  source: /note="Description of Artificial Sequence: Synthetic polynucleotide"

SEQ ID NO: 1390 - DNA, 321 bp, Artificial Sequence; identical to SEQ ID NO: 1386
  source: /note="Description of Artificial Sequence: Synthetic polynucleotide"

SEQ ID NO: 1391 - DNA, 360 bp, Artificial Sequence; identical to SEQ ID NO: 1383
  source: /note="Description of Artificial Sequence: Synthetic polynucleotide"

SEQ ID NO: 1392 - DNA, 321 bp, Artificial Sequence
  source: /note="Description of Artificial Sequence: Synthetic polynucleotide"
atggacatgagggtgcccgctcagctcctggggctcctgctgctgtggctgagaggtgcgcgctgtgaaatcgtgctgacgcagtctccagccaccctgtctctgtctccaggggaaagagccaccctctcctgcagggccagtcagagtgttgatctgcacttagcctggtaccagcagaaacctggccaggctcccaggctcctcatctacgaagcagccaccagggccactggtatcccagacaggttcagtggcagtgggtctgggacagagttcactctcaccatcagcaggctggagcctgaagattttgcagtt

SEQ ID NO: 1393 - DNA, 360 bp, Artificial Sequence; identical to SEQ ID NO: 1383
  source: /note="Description of Artificial Sequence: Synthetic polynucleotide"

SEQ ID NO: 1394 - DNA, 321 bp, Artificial Sequence
  source: /note="Description of Artificial Sequence: Synthetic polynucleotide"
atggacatgagggtgcccgctcagctcctggggctcctgctgctgtggctgagaggtgcgcgctgtgaaatcgtgctgacgcagtctccagccaccctgtctctgtctccaggggaaagagccaccctctcctgcagggccagtcagagtgttaacctgaacttagcctggtaccagcagaaacctggccaggctcccaggctcctcatctaccaggcagccaccagggccactggtatcccagacaggttcagtggcagtgggtctgggacagagttcactctcaccatcagcaggctggagcctgaagattttgcagtt

SEQ ID NO: 1395 - DNA, 360 bp, Artificial Sequence; identical to SEQ ID NO: 1383
  source: /note="Description of Artificial Sequence: Synthetic polynucleotide"

SEQ ID NO: 1396 - DNA, 321 bp, Artificial Sequence
  source: /note="Description of Artificial Sequence: Synthetic polynucleotide"
atggacatgagggtgcccgctcagctcctggggctcctgctgctgtggctgagaggtgcgcgctgtgaaatcgtgctgacgcagtctccagccaccctgtctctgtctccaggggaaagagccaccctctcctgcagggccagtcagagtgttttcagccacttagcctggtaccagcagaaacctggccaggctcccaggctcctcatctacgaagcagccaccagggccactggtatcccagacaggttcagtggcagtgggtctgggacagagttcactctcaccatcagcaggctggagcctgaagattttgcagtt

SEQ ID NO: 1397 - DNA, 360 bp, Artificial Sequence
  source: /note="Description of Artificial Sequence: Synthetic polynucleotide"
atggacatgagggtgcccgctcagctcctggggctcctgctgctgtggctgagaggtgcgcgctgtcaggtgcagctggtggagtctgggggaggcgtggtccagcctgggaggtccctgagactctcctgtgcagcatctggattcaccttccagaactatggcatgcactgggtccgccaggctccaggcgaggggctggagtgggtggcagctatctggtttgatgcgtctgacaaatactatgcagacgccgtgaagggccgattcaccatctccagagacaactccaagaacacgctgtatctgcaaatgaacagcctgagagccgaggacacggctgtgtattactgtgcgaga

SEQ ID NO: 1398 - protein, 4 aa, Artificial Sequence
  source: /note="Description of Artificial Sequence: Synthetic peptide"
KKKP

SEQ ID NO: 1399 - protein, 6 aa, Artificial Sequence
  source: /note="Description of Artificial Sequence: Synthetic 6xHis tag"
HHHHHH

What is claimed is:

1. An isolated antigen binding protein that specifically binds to a human gastric inhibitory peptide receptor (GIPR) polypeptide, wherein said antigen binding protein is an antibody or a fragment thereof, wherein the fragment is a Fab fragment, a Fab' fragment, or a F(ab')2 fragment, and wherein said antibody is a GIPR antagonist and comprises a CDRL1, a CDRL2, a CDRL3, a CDRH1, a CDRH2, and a CDRH3, wherein each CDRL1, CDRL2, CDRL3, CDRH1, CDRH2, and CDRH3, respectively, comprises SEQ ID NO: 1290, SEQ ID NO: 1291, SEQ ID NO: 1292, SEQ ID NO: 1293, SEQ ID NO: 1294, and SEQ ID NO: 1295.

2. A method of treating a subject with a metabolic disorder, the method comprising administering to the subject a therapeutically effective amount of an antigen binding protein according to claim 1.

3. The method of claim 2, wherein said metabolic disorder is a disorder of glucose metabolism.

4. The method of claim 3, wherein said glucose metabolism disorder comprises hyperglycemia and wherein said administering reduces plasma glucose in said subject.

5. The method of claim 3, wherein said glucose metabolism disorder comprises hyperinsulinemia and wherein said administering reduces plasma insulin in said subject.

6. The method of claim 3, wherein said glucose metabolism disorder comprises glucose intolerance and wherein said administering increases glucose tolerance in said subject.

7. The method of claim 3, wherein said glucose metabolism disorder comprises insulin resistance and wherein said administering decreases insulin resistance in said subject.

8. The method of claim 3, wherein said glucose metabolism disorder comprises diabetes mellitus.

9. The method of claim 3, wherein said subject is obese.

10. The method of claim 9, wherein said administering reduces body weight in said subject.

11. The method of claim 9, wherein said administering reduces body weight gain in said subject.

12. The method of claim 9, where said administering reduces fat mass in said subject.

13. The method of claim 9, wherein said glucose metabolism disorder comprises insulin resistance and wherein said administering reduces insulin resistance in said subject.

14. The method of claim 9, where said subject has increased liver steatosis, and wherein said administering reduces liver steatosis in said subject.

15. The method of claim 9, where said subject has increased liver fat content, and wherein said administering reduces liver fat content in said subject.

16. The method of claim 2, wherein said subject is a mammal.

17. The method of claim 2, wherein said subject is human.

18. The method of claim 2, wherein said administering is by parenteral injection.

19. The method of claim 2, wherein said administering is by subcutaneous injection.

20. The isolated antigen binding protein of claim 1, wherein said human GIPR has a sequence comprising a sequence selected from the group consisting of SEQ ID NO: 1201, SEQ ID NO: 1203, and SEQ ID NO: 1205.

21. The isolated antigen binding protein of claim 20, wherein said antigen binding protein is a monoclonal antibody, a polyclonal antibody, a recombinant antibody, a humanized antibody, a chimeric antibody, a multispecific antibody, or an antibody fragment thereof.

22. The isolated antigen binding protein of claim 21, wherein said antigen binding protein is a monoclonal antibody.

23. The isolated antigen binding protein of claim 21, wherein said antigen binding protein is of the IgG1-, IgG2-IgG3- or IgG4-type.

24. The isolated antigen binding protein of claim 23, wherein said antigen binding protein is of the IgG1- or the IgG2-type.

25. The isolated antigen binding protein of claim 21, wherein said antigen binding protein is coupled to a labeling group.

26. The isolated antigen binding protein of claim 21, wherein said antigen binding protein inhibits binding of GIP to the extracellular portion of human GIPR.

27. The isolated antigen binding protein of claim 21, wherein said antigen binding protein is an antibody or a fragment thereof, and wherein said antibody or fragment thereof comprises a light chain variable region comprising SEQ ID NO: 1286 and a heavy chain variable region comprising SEQ ID NO: 1287.

28. The isolated antigen binding protein of claim 21, wherein said antigen binding protein is an antibody, and wherein said antibody comprises a light chain comprising SEQ ID NO: 1288 and a heavy chain comprising SEQ ID NO: 1289.

29. A nucleic acid molecule encoding the antibody or fragment thereof according to claim 1.

30. The nucleic acid molecule according to claim 29, wherein said nucleic acid molecule is operably linked to a control sequence.

31. A vector comprising a nucleic acid molecule according to claim 30.

32. A host cell comprising the vector according to claim 31.

33. A method of making the antibody or fragment thereof according to claim 1, comprising the step of preparing said antibody or fragment thereof from a host cell that secretes said antibody.

34. A pharmaceutical composition comprising at least one antibody or fragment thereof according to claim 1, and pharmaceutically acceptable excipient.

35. A composition comprising a therapeutically effective amount of a GLP-1 receptor agonist and a therapeutically effective amount of a GIPR antagonist, wherein the GIPR antagonist is the antigen binding protein of claim 1.

36. The composition of claim 35, wherein the molar ratio of a GLP-1 receptor agonist to a GIPR antagonist is from 1:1 to 1:110, 1:1 to 1:100, 1:1 to 1:75, 1:1 to 1:50, 1:1 to 1:25, 1:1 to 1:10, 1:1 to 1:5, or 1:1.

37. The composition of claim 35, wherein the molar ratio of a GIPR antagonist to a GLP-1 receptor agonist is from 1:1 to 1:110, 1:1 to 1:100, 1:1 to 1:75, 1:1 to 1:50, 1:1 to 1:25, 1:1 to 1:10, or 1:1 to 1:5.

38. The composition of claim 35, wherein the GLP-1 receptor agonist is in combination with the GIPR antagonist at therapeutically effective molar ratios of between 1:1.5 to 1:150.

39. The composition of claim 38, wherein the GLP-1 receptor agonist is in combination with the GIPR antagonist at therapeutically effective molar ratios of between 1:2 to 1:50.

40. The composition of claim 35, wherein the GLP-1 receptor agonist and the GIPR antagonist are present in doses that are at least 1.1 to 1.4, 1.5, 2, 3, 4, 5, 6, 7, 8, 9, or 10 fold lower than the doses of each compound alone required to treat a condition and/or disease.

41. The composition of claim 35, wherein the GLP-1 receptor agonist is GLP-1(7-37) or a GLP-1(7-37) analog.

42. The composition of claim 41, wherein the GLP-1 receptor agonist is selected from the group consisting of exenatide, liraglutide, lixisenatide, albiglutide, dulaglutide, semaglutide, and taspoglutide.

43. The composition of claim 35, wherein the GLP-1 receptor agonist is selected from the group consisting of GLP-1(7-37) (SEQ ID NO: 1244); GLP-1(7-36)-$NH_2$ (SEQ ID NO: 1245); liraglutide; albiglutide; taspoglutide; dulaglutide, semaglutide, LY2428757; desamino-$His^7$,$Arg^{26}$,$Lys^{34}$($N^\varepsilon$-(γ-Glu(N-α-hexadecanoyl)))-GLP-1(7-37) (core peptide disclosed as SEQ ID NO: 1282); desamino-$His^7$,$Arg^{26}$,$Lys^{34}$($N^\varepsilon$-octanoyl)-GLP-1(7-37) (SEQ ID NO: 1283); $Arg^{26,34}$,$Lys^{38}$($N^\varepsilon$-(ω-carboxypentadecanoyl)-GLP-1(7-38) (SEQ ID NO: 1284); $Arg^{26,34}$,$Lys^{36}$($N^\varepsilon$-(γ-Glu(N-α-hexadecanoyl)))-GLP-1(7-36) (core peptide disclosed as SEQ ID NO: 1285); $Aib^{8,35}$,$Arg^{26,34}$,$Phe^{31}$-GLP-1(7-36)) (SEQ ID NO: 1246); $HXaa_8EGTFTSDVSSYLEXaa_{22}Xaa_{23}AAKEFIXaa_{30}WLXaa_{33}Xaa_{34}GXaa_{36}Xaa_{37}$; wherein $Xaa_8$ is A, V, or G; $Xaa_{22}$ is G, K, or E; $Xaa_{23}$ is Q or K; $Xaa_{30}$ is A or E; $Xaa_{33}$ is V or K; $Xaa_{34}$ is K, N, or R; $Xaa_{36}$ is R or G; and $Xaa_{37}$ is G, H, P, or absent (SEQ ID NO: 1247); $Arg^{34}$-GLP-1(7-37) (SEQ ID NO: 1248); $Glu^{30}$-GLP-1(7-37) (SEQ ID NO: 1249); $Lys^{22}$-GLP-1(7-37) (SEQ ID NO: 1250); $Gly^{8,36}$,$Glu^{22}$-GLP-1(7-37) (SEQ ID NO: 1251); $Val^8$,$Glu^{22}$,$Gly^{36}$-GLP-1(7-37) (SEQ ID NO: 1252); $Gly^{8,36}$,$Glu^{22}$,$Lys^{33}$,$Asn^{34}$-GLP-1(7-37) (SEQ ID NO: 1253); $Val^8$,$Glu^{22}$,$Lys^{33}$,$Asn^{34}$,$Gly^{36}$-GLP-1(7-37) (SEQ ID NO: 1254); $Gly^{8,36}$,$Glu^{22}$,$Pro^{37}$-GLP-1(7-37) (SEQ ID NO: 1255); $Val^8$,$Glu^{22}$,$Gly^{36}Pro^{37}$-GLP-1(7-37) (SEQ ID NO: 1256); $Gly^{8,36}$,$Glu^{22}$,$Lys^{33}$,$Asn^{34}$,$Pro^{37}$-GLP-1(7-37) (SEQ ID NO: 1257); $Val^8$,$Glu^{22}$,$Lys^{33}$,$Asn^{34}$,$Gly^{36}$,$Pro^{37}$-GLP-1(7-37) (SEQ ID NO: 1258); $Gly^{8,36}$,$Glu^{22}$-GLP-1(7-36) (SEQ ID NO: 1259); $Val^8$,$Glu^{22}$,$Gly^{36}$-GLP-1(7-36) (SEQ ID NO: 1260); $Val^8$,$Glu^{22}$,$Asn^{34}$,$Gly^{36}$-GLP-1(7-36) (SEQ ID NO: 1261); and $Gly^{8,36}$,$Glu^{22}$,$Asn^{34}$-GLP-1(7-36) (SEQ ID NO: 1262).

44. The composition of claim 35, wherein human GIPR has a sequence comprising a sequence selected from the group consisting of SEQ ID NO: 1201, SEQ ID NO: 1203, and SEQ ID NO: 1205.

45. The composition of claim 44, wherein the antigen binding protein is a monoclonal antibody, a polyclonal antibody, a recombinant antibody, a humanized antibody, a chimeric antibody, a multispecific antibody, or an antibody fragment thereof.

46. The composition of claim 45, wherein the antigen binding protein is a monoclonal antibody.

47. The composition of claim 45, wherein the antigen binding protein is of the IgG1-, IgG2-IgG3- or IgG4-type.

48. The composition of claim 47, wherein the antigen binding protein is of the IgG1- or the IgG2-type.

49. The composition of claim 45, wherein the antigen binding protein is coupled to a labeling group.

* * * * *